United States Patent 10,900,036 (RNA INTERACTOME OF POLYCOMB REPRESSIVE COMPLEX 1 (PRC1)) - sequence listing, part 7

SEQ ID NO: 13385 - DNA, 1141 bp, Homo sapiens
ccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctgg

SEQ ID NO: 13386 - DNA, 1148 bp, Homo sapiens
tctgaatcagcatacctcttgcaccctgctcagtgtgcgctgggcctcacttaagccctgacctgagggggcggttctgtctcttgggggaggggcccatgggtgcccggtcagcctgcctcaggggctgcctgtacaatccacaaccccagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccaggtgagccccaccagaccccattgggagactcgagctgggggtttctctggcctcactgaccactgctgcccacagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaaggtgggctgggtgagcagggtagaggggctctggctccgggccccacccttaggagtcgaggccctgagtgtccgtccctggcccccaccccttcctcagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtcagtgcccagtcctctgctctttcccggagccacctggagcccagccccatggttcacctggagctggcccttctgcccaccaggtggaactccacgctgcagaccctggtggcctcgtatgaagcctatgaggacctgatgaagaagtcgcaggagggcagggacttctacgcagatctggagagcaaggtggctgctct

SEQ ID NO: 13387 - DNA, 1141 bp, Homo sapiens
ctctagagggaccggaagattcagggaaggtacttccccttccctttcagccctttctgaagaaagtgtgagggtttcttctgccccctggtggagacggggtgagctgctgctggtatgtgagctgaggaccaaccagcatctctcatctctgctgtgccctgcctgctgctgccctgccggttatgaggtggctgcagtccgggtactgctcctcttgggctgggacagtgaggtcacggcacccccccatccccatgtgctctgattccaggagttctgtctctttgctgtcgtggggctggtgtctgacttcttccttcagatgctgtttttcaccactgtcctgtccattgacattcgccggatggaggtaggagtgggctgagccctgccctgcccgcctcctcagccctggctgtactgagggagtcctgggtgagaagggtgtagacctcgggcaggacagcggtcctgtgcgagcagcctctggatggtggactcaggccctgaccactgtgcccccaacagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggtacctgccacccctgccctgccctgccctcttctggagggccggtgctccaggccccttgtggtgctgcacttggccttagagtggcaaagggtattcctcaggccctggtggcccctggaagcctggctctggggagttgcccgttgtgtcctccctgcccagaccctagtggcttctgaggagataagcctgtgggagaagcagctccagggttctcaggtacaggagccatcctctccccagagtggcccaggacaggagcctgttagttgagtgctctgggatggacccacttgtggccaccacattgccctgggtcgggttcatcggccgctgcatggtgtgcagacactggaaagtgctgggcaaaatcattcaccagccgggc

SEQ ID NO: 13388 - DNA, 1110 bp, Homo sapiens
aagcctttaaaaaccgataaccagcaccaggtacaattctgtacttatcaataaaatttaaaataatttttttaataaagaaagaaatacagtatttgttttttgtagggattttttgtaatttttttttttttgagatggagtctcgctctgtcagccaggctggagtgcagtggcacgatcttggctccctgcaacctccgcctcctgggttcaaacaattctcctgcctcagcctcccaggtagctgggattacaggcgcctgccaccacgcccagctaatttttgtatttttagtagagacggggtttcaccatgttggccaagctaatctgaaactcctgacctcgagtgatctgcccaccatagcctcccaaagtgctaggattacaggcgcgagccaccacgcccagccgaaatacagtatttgatccagaagctgagacattgtcatgttttgccgtgattatttcacttacatgtttccttcactcttctctcctaaccagcaaattccggaccccatctgagctccacaatgataacttctccctctccaccattgccgagggctctcacccaaatgtaaggaaactttgcaacactccccgtacctcctccccccatgcccgtgccttggctcactatgataacgttatctgtcaggtaacttgttttcttcacatctctcctcttatgcatgctttggcccctggcccatgtctgatgtctatttcagaatatgaaatccccagagagctctggaggtcagcctagggcaactgagttgggcagcaaaggtgggaataagcacttgatggtgtatcacttatttgacaagcagaattttcgatacaaaaggtctttttctttttaaaatttttgtagagatgaggtcttcctgtgttgcccaggctggtctcgaactcctggcctcaagtggtcttcctgcctcaggctcctaaagtgctaggattataggtgtgagccacctgcctggctgagaagatctttttctagggttactcatgatttttagcttcatctaagctttagaagtctgattattgtcttattttccatatcaaggagaaaggctctgctttcac

SEQ ID NO: 13389 - DNA, 2899 bp, Homo sapiens
ggaaaggacttctgtgtctttttttcactgaataggctctttcctgagtctcttgtatttccagcaataacgagttactcttggatatgtttgcagatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactca

SEQ ID NO: 13390 - DNA, 1107 bp, Homo sapiens
gggtttcaccatgttattggccaggctgctctcgaactcctgacctcaggtgatctgcccacctctgcctcccaaagtgctgagattatacgcgtgagccaccgtgcctggactactttctttacagtatgcatgtcttttatttattttacttgcctgattgaaaataatctaaggaaaccatcaaatctttctatttatgcataaatatttgcattaattttttttaaaaaagctatctaaagaacttctaatattacacattactttcttgttacctgacatgaaagcatctgttttttctgtcttaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttgggtatggacttccctaaaccatctcctcaacagaaaaactcagtttatcccaatttaaatattaccagccgttacattcatttcttttaatgtaaataacaaaaatcagatattacctgtgaaagataccatattctttataaaagtattacaatatttggctggacaccaaattagctgggtgtggtggcacatgcctatagtcccagctacttgggaggctgaggcaggagaatcgcttgaacccaggaggcagaggttgcagtgagccgagatcgtgccactgcactccatcccctgggcaatagagcaagactccgtctcaaaaaaaaaaaaaaagtattacaaaatttttaagtaatgcaccttaaaattaagagctttaggaattggagggacagaggttttttattgtgtattttgtgattaatttagaatttggtgtaactagcaaaggaagtcatttaatattcatgggttacacattaattgtaactagaactttgtcacatcatagaactctttcttggttttatgg

SEQ ID NO: 13391 - DNA, 1196 bp, Homo sapiens
aatgtatcttcttgggcttggtgcggtggctcatgtctgtaatcctagcactttgggaggccaaggcgggcggatctgttgggtccaggagttcaagaccatcctgggcaacatggtgaagccctgttgctacaaaaattcgctgggcgttgtggtgcatgcctttagtcccagttactttggaagttgaggtgggagggtcacctgagcccaggaggcagaggttgtagtgagccgtgattgtgccactgcactccagtctgggtgacagagcgagaccctgtgtcaaaaaaacaaaaaacaaacagtatcttctgctcacccattgccatgtggggttatttgtttgcatcaaagctaggcatctttgagagttccatgcccagttctggactaggggctgaagtgggtaaacagatgaaaaaccacggctgcacaacacaacttaacggtgtagctggacacggaccaggccgactgaggtgtaaagatggtatcaatccttaaaacgtcccttttcccctccagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaaggtacagatggaggatggggatgcagcagaggctggctgtgccttgacacggggatgggcgaatgttctctgctagctttctctgagatgggagcgcccctgcctcacatttcagcctgtgtgccccatcactcagtgtgtgtctgcccattcttgggggacagccagctgtggtcttctatgtggctgggcttttgcagaacagcagcatggagcccctgctctctgctatcttatctgtgtgagggaatggagggagcagtccccatgcagtgtggctgtgggaggagcagagacgcccggtttcccatccatttcatgccttctgcccttctggctccctgctgcagcgcagcgtcctcacccc

SEQ ID NO: 13392 - DNA, 1113 bp, Homo sapiens
gactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgaggtgagggacacccccatcccacccaaggctcctggcctttcctccgtggatgcccctcctccctggccctggggcttggtgcctggggcaagttaccctccccagtcctcggtttccttgatagaaactggggactaaccctgcctgcgtggcacacgtgaggattggagttgatgtcaagcggctccgtctcactgagtcaggtggctgtgtccttggcatgaccccttaccccggggctgtgactgtggcctctcttcccccaccccagtctgaggatgaatgcgcactcgatttggaccttgtgactgatctggttctgcacatcgatgctcgcggggaaccaggtgggtgcctccccatctgtcccatgctagccctggccacgtttgcagcaacagctggctcatgccccagggctcctttacaggtgggatcctgtgcttcctgcctgggtggcaggagatcaaaggagtgcagcagcgcctccaggaggccctgggcatgcacgagagcaagtacctcatcctgccaggtgagagccccggcggagggaccagggacctttggaaaccagcctgacctctgtcctagggactgacccaactgggactccaggggccccggtttctgaccaagctgtggcacttttcactgggcatagtgtttatctgcgcctgtttcatcaaaatggggtcaaaatccttgccctgcccacattccaggggggaattctggtggaagcagtgcccataactggtgtgtgtcttgcccaccagtgcactccaacatccccatgatggatcagaaggccatattccagcagcctccagttggggtgcgcaagattgtcttggccaccaacattgctgagacttccatcacaat

SEQ ID NO: 13393 - DNA, 1626 bp, Homo sapiens
aggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcaggcttcgtgcttctgtctcgttttgcatctaccacctccctggatcttcctgccctcagctcagcccctcagctgtgaacttgtggatgtggacacgggaaggaccactgtgccacatagccctgcgccttggctacctgtggaactctcccctagtctgcctgataaagggctacttgacacttacttgcttacttactgtccaaaactacaaggacagtgacagttctgacaggcttcctgtggtgggtaccgagagcagcagctgtgccaggggactggggtggttaacagcaccgctgcttcatgctctttcttggtgaagggaggaggttccaaccccctt

SEQ ID NO: 13394 - DNA, 1123 bp, Homo sapiens
ttcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagagagacacttgacatgagcctagtttttcatggttcttagcctgcacagagaatgtcaggataggcagaaggtagaacacctcttacttccacaacccatgacttgagtggaatatatctgaaagaggactagggtgtcctcttatggccaggatgagtcgtgctgtgagcctctggccttcctaaacagcaggactgcactgcatatagtgatggagaaagatcaca

SEQ ID NO: 13395 - DNA, 1100 bp, Homo sapiens
gtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattgccccatgtattcttccct

SEQ ID NO: 13396 - DNA, 1138 bp, Homo sapiens
gaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaaggagaattacatttccctttaaggtcctgggaccacattaactaaaattagtgtttgggatggccacatttcctcaagaagctctgactccaaaaacttgtggttcagattgatttgcaagatgaaatgggtgcataaaaagtgtgcctgaggccagccgcagtggctcatgcttgtaatccccgcattttgggaggccgaggcaggcagatcacttgaggccaggaggtcaaggctgcagtgcccacacataatgtgatgctgggggctactggggacaaaatatattgggctgaagcacagagggacgcccagaatagaaaacacatggtcctttaggtatgggttggaaaaccaggggttcaggcatatttgattatattatatatacatatatttttctgagacagtctcactgttgcccaggc

SEQ ID NO: 13397 - DNA, 1179 bp, Homo sapiens
gcattctctaggccattttatggtctttatagagatttgcatctgcttgccctaactcatttcagcagattctcatactgtcacagtcctcaatgctgatcggtgttcactgatgcaaccttctaataaaagaaaccttgttcttcacaagaggctatctctagtacccattataaggtgaattgcttctggcaagagttctctgtaaaggctactgactactcagggctgtgtgtggtcatcaaatcatttataatcttgggatacattttcatataatcagtaatggctaaaattttgctttgtataacaagtataacatagtatgttttcatcataaaaactagtgacccattcaaggaaatgaaagtggatcagagctctcattattaatccatgaattttgtcttacagctttcctcaaatgaaagagatagcagtgaaccagggaatttcattcctctttttacaccccagtcacctgtgacagccactttgtctgatgaggatgatggcttcgtggaccttctcgatggagagaatctgaaggtaccgtgtgtgtgtgtgtgtgttcctatttgttctactaattaattacctctggagaaggcatgtgatgtgaaaaagaacagcaacagcagttccccggggcttgcttagctgatatttttgttcatttggtgataattcatttaataatagggctaccagccttattaaatcctttggattgggggatgggggcatcaaaagaagacacatgatccttcttaccctgaaggagctaactaacaatctatatgcaagaaacatgaaatcagaacggtataggatggtacattaaggatacttcctatccaggcctatctggtattgttcagggagaaacacacctaaagcacttaaacaaatgttagtctctacaggctctttttaaaatcagtttttctgtttctttagaatgaggaggagaccccctcgtgcatggcaagcctctggacagctcctctcgtcatgagaactacaaaccttgtgagttgttctagtgtgtctggaggaagccctgcgtgattggggcactggacagagtagtccttagttgagtatagccaaagattgaaatgcatgataggatttggggatctgggttttaggcctcactttggctacctacaaatt

SEQ ID NO: 13398 - DNA, 1124 bp, Homo sapiens
tcacctctatctgaataaccaaacaatcatgatatgaatcagttttattcaccctcttctcaaatcctatttcccttgatgttatttgcaaataggagaaaaaacagtaaatacgctatgaaaatattaagacttgtacaaacatgacatttttgacaatctaatagacgtaacatcaattctggcaaaagtacaagccatgaatatttgttgcctgacttaaataaagacccaggtactttgtttagtgttttaattttaatgacaaaatggtgttttttgtattatttcttgagaggttttttttttccccataggtttctgtctagattctcctgggccattggacagtaaagaaaagtatgtattcactgctttcaaatgtttatatgtagaaaaaacgtgtctaaacttaaataccttatttaaatgaagttcttcatacactggactggagccctggatttacctgtgcctagaaacactctggaatctcaagaatgaatagtttgtgtcagcaattttcagaactttttctcctttattttagctataattttggtgttctgtttgggtcttacccaaacccttactctgtgctctgacatcatagccttacaagaacatgtggggtttttttgtttgtttgtttgtttgtttctgaggcagagtctcactctgccgcccaggctagagtgcagtggctcactgcaacctccacctcccaggttcaactgattctcctgcctcagcctcccgagtagctgggactacaggagtgcaccaccacacccggttaatttttgtatttttagtagacacgaggtttcatcgtgttggccaggccaggagttcgagactcctgacctcgtgatataccctcctcggcctcccatagtgcccatagtgctgggattacatgtgtgagccaccgcgcccagccgaatgtgtgtattttaagaaaagacatgggtttgttttttttcacctagaagtctagtgttgggggtgctcctgagaacaggacagcttcagaaatttattctcccatctcttgcctaaaatgggagtctgtgactgtacccccaagctacaggctaaacactatctctctgctaatatga

SEQ ID NO: 13399 - DNA, 1160 bp, Homo sapiens
tttttttggccctaaataaagccatccactgtagggttgcccctacaatccacaaagtccttgtccctaaggagccatgttggtcttgtctgtgccgggggtagtcatagctgctattcttcgctgtggctccattgtcccttctttcccatttctgccggatgtggggaccacagtcaggtcagcagccaggtgccatcatttgggagcatgtgagcttggatgctctggccaggttttcatagccacccagaatggtcctgacttttcccgttggagaccatggaatgggtctccatcttgaccatctctgggagcagggtggatgggaaatccacttgagggtggacttcaagcagacacagagggaagcagccttggtcagcaccacagacctcgacagagccatgcctctgttccagaggcctctctgttccaggttcaggcccctgcaggttttaggggtaggtgaaggctcccgggagaggggggccatgtgcctgcaagcctgggcacgtgcccgcgggaggggtgagtactgaacgtgctttgagtcactcactgagtcatggctcggccgccacagaacattgttataataacagacatagagaagaaaaacctggcacaagaagataggaaattctgtcttcactccaaaccatgaccaagaatggagattccaacaccagcaagaatttgtgatcgcttaacttgggtcatgaccacaatttcagcatagaacatttgtaattcagtttgatcaatcttttcctaatttttattaagactgcaacgaaagtgtgccctcattattacatttttcacaaacctgttagcatacaaagggcctttgtttctcattaccacccggggctccttaaggcgttttatggagtgatgtgctttattaaaaagcgttttcaccaacttaaaagttggaataattgtccaaatggttacatgacccaggagttctatatttttattaattttctgatactgaaataatcgtgctaattaagataacagctgaatttatgctgatgaatgttggaattcttagaagccacctgaaaccttccaaatggtcaggacctggatcccactggccagtgccaacaggtgactctgggtggtgctgggggatacagggaacc

SEQ ID NO: 13400 - DNA, 1154 bp, Homo sapiens
aggcacaagccagggcatgactgctgggaggggcctctgggtggggccagggacccacttgtgggtgagccactggtgtttggattgctggcctcaggtcctctttgctgtcacagcttctgaaggttcctgtggcttcctgtgctcagcacctggactgtgcatcttgccttgctcacagggacccatactgtgggtggtgcgtgctccttggcaggtcagatttctgaccccatcccagccccagcctcaagcccacaatgctcctgcataattgtcctgtccagaattcctgacccttagaccatgactctcaacccctgatccccagacaccccaattcctcacccccatcctctgcactgggcatcagtgccctgccagggcagacacaggagcctctatcatgcccactctagggccctgcccaggtcctccagattgtaggagtccctaccctatgaactcccagtggcccatgagggtcacagatagacactggtcatctcgcccaggtgcagtcgccgttctgagtgctcgaggggccagggcccagagcagtggctatggagcttccagcctgagctgggctgtctgcaagtggcagccatgagtcctgccaacatcagccgagaggagacgagggaggtgaatgatcagataggcagggccctggtggggagggctctgggcatcaaggtctgggtagagatcttggatcctgatgtcggacatgccagataccacatggcctcacacaagtcacttcttttaggagctcagtttccccatctatttctaactcaggccagagggtgtttggggaggcctgagggctgttgattgctggtgcctgcccacattgggtgtcccataaatgtgagccctggtctgctgcccactagccccaacagtgtgtccctggctctcttggcaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccggtgggtgagagaatgggccagcctggtgggggccagcccctgcttcaggggatgcggtgg

SEQ ID NO: 13401 - DNA, 1916 bp, Homo sapiens
atgggtggcaagcctggctctcaagacctggggagatggaggagggtcctgactggaattctctttgcagcggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaatcaggctgtactctttccatccatttgggcttctctgtgttttccctacttttactgggctcagatagttgaccatcctgctagggaaagtgagggacaaacac

SEQ ID NO: 13402 - DNA, 1282 bp, Homo sapiens
ggaggacccccatgtgcatggttatcctggtgactccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcc

SEQ ID NO: 13403 - DNA, 1098 bp, Homo sapiens
aatatttagtgtgataaaatatacagtctaaaccaatagtcccttccttaatgatgaaaggataaaatcattgccagaacaaaggcagcgtgtaatttttagaaaggaaaaaataagttgttatttgcaaatgatatgttgtatgcttagacaaaaacaaataattaactgaaaattgagagtgaatttaaggatttgtatgctggtgagaccaggtaaatgtgcacagttagaagtgtccctgtgggtccttgatagccaatcaggagagcaatgatgtggtgtgacgagtcattcggctgcccctgttttccaagcatgactgtgtccccaagcacaggggtcctgctggggcagctctccctgactccaggattcataagtccctgcctggggcttgtactgagtcactcaggtggggtgtgagtagggggctggggagtggtttgtttgtaaccttttctggtggcttcttgaccaggtgggagtgtggattgatgttggcagccgttttgagactgagaagaataatggggcaggctactttttggagcatctggctttcaaggtgaggctcttaaagtctgtctcctctgggcttagggctgcctgttgtccctcctgaggatgaaggtcagaaaaattagcctgattatgggcctcagttgcggggctgatgtctggctggctttcctaaaaggagccacatgagcttaacctctcctgagtgggcacgtatctgatgagcccctgcctgaggccctcagagccaagaggacccaaggaaccataggagccccacttttcaccagagaagccaggcctgtggaacacacgtagatatgcacatgcattttaacaaacccacagacatgggcatgcatgcttgcttatgaaatgttcttctctggtggaatatctaggcatcccttggttgtaaagacccatgttttttaaaggaatgaaaaacatggagaaggattatggggtgggcagggccatggagccatagtaggcaacctagccagctgcaatgtcacaggtatgtgtgcagaattaacgtgtgtgtgcacaccaagagatagcaccactgttctc

SEQ ID NO: 13404 - DNA, 1183 bp, Homo sapiens
acccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctcc

SEQ ID NO: 13405 - DNA, 1198 bp, Homo sapiens
tggccggcggggccaccatgtccttatggtctcactggactttagcctcttccaggtctggcctctgaccccggggtagtctgttctcagccttccaaccagatccgccttatttgaccccacctctagtccagctcctctcagttccctccactgcactgagtctgatgttctacccctagttccccaccatatatccttgcactgagcccacccaccagccaagttggtccactctcaagccctctttgtgccagatttggggcctggtcttggggaacctctgtagccagcactttgcctgattcctagaagccccttctagtctctgccccagtctctacccacccccggtcaaaatcaagcaatattaaggtctactgtgggtccaggagggagggggcagcctagaagggctagaagaaggccaagactgactctgggctatgacaggggttcatcaggcccctctccctcagtgctgactgccccacttcctccaggacaccatggcggtggggagtgagctgcagggcctgaaggtaaagcagctccacgtgggaggcctgccccccggcagtgcagaggaggctcctcagggtctggttggctgcatccaggtgggggtcagcatgggaatgtgatatggggcattagggtcaggggtcagaagtcaggggctccttgggacctgaaaggcagtattcaagtgggggttggtgcgagggggtgaatgacccagagttgagagctaggtcaagcctttctgtggcattggaggtgggagtctagcttggattatcaagggcctttaggaatctgtgtcagaaacagcacaattagggtcccacaggggtaccaaattggggatatttttgaggcctgggttttttgagggtatcagaagactgcatgtcaaggatcatcagaccgggtggctggctctgcagtacttgaggctgaggtgccttaacatggtctcaccccttgctggctgtgtgtccacagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggtgagccttgagagggtt

SEQ ID NO: 13406 - DNA, 1173 bp, Homo sapiens
ggatgattcgtttattcgcttactcaaaaactattgaagaccaattctgtgccaggtatattgtgggtgctggggatgcagccctgatgttcaggtccacagccctggggtctgtgggacagtggggtcctgtccctgtccagtggtggttgcagtacctccctggggtccctgagctggcctgctcttcccacagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaacaggcttccctgtatgatcttgggagacagtgggagaggatgggcagaagtactggggcctcaggaccccatc

SEQ ID NO: 13407 - DNA, 3140 bp, Homo sapiens
gctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtccttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatgtctgactttctggtgcagtcttatgttacgtgtttgccattttgcttcagggctccaggccgtcatagcactcctttggcagattcattcttctggtagatctgggattagggtatgagcccttgaaaattagggaccccttgtactagtcagggttctccagagaagcagtcagtagggtgtgtgtgtatgtgtataaagattctttttttttttttttttttttttttagtgacaggatctcactatgttgtccaggctggtttcaaactcctaggctcaagcagtcttcctgcctcagcttccagcttcccaaagtgctggaattataggtgtgagccactgcacccagcctaaagatttattataaggaattggctcacacagttatggaggtgggcaagtcccaagatctgcagggtgaattggctagctgtagacccaggagagccaatggtttagttcc

SEQ ID NO: 13408 - DNA, 1339 bp, Homo sapiens
tgcatgagggaaatggcttgaattcattctctccctcacctctttttaacaatgcagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgc

SEQ ID NO: 13409 - DNA, 1231 bp, Homo sapiens
cctatttttcagacacctaaaagtaatgtctgtgaaacagtggttttctttttctacatattacagcaggaagtgttcctatttatgtactgtctgtatcaatactaacggggcatgataagcaaaattttaaactttggtagttaaacctttatgttgcctcccctctgggctgccagctgtggggatgtgcttctcccttaaggactttggcaagaataacaagttcattggaatttgactttctgacatagagcagacagccttgccctgtcatgccaggcctttcatgtgaagttaccatttattagctgcttctgtctctccagggaaggatttcccttttataagcctgggccagggggatgatagtaagattccccatgtgataccagagttggaataggctgtagtgagattagggccaggactgtcccattttgattcttgaatggtttctgttacaacttgtcatggggaaaaagtaacacttattttttttttcctcccttagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtgagcagtgttgtaaactccagtgtaatcccccccagttaaatctaaggatgagctgttgttaattaatgtctcctccagactaattgaatggccttgtagcttgaaaccaaatttaagtgtatgtcaacatcatttggacattttgttacatttactttgttttctaatatatgcatgtctaaggtcctcagattcccaaattagtaagaattagaaagtaggggtgggacagattcaagaaagatgtaccataccagaaatgtgtagtagcagaattgcacaactttgcacgtttcaggaagtgagttttcagaattttatgaggttgatacaataagcatcagaatcaccatcttctgtac

SEQ ID NO: 13410 - DNA, 1149 bp, Homo sapiens
aaatgtgttttttaaaatagaagaaaaagggggaaagcctttattcttagtttcatatacaaaaatctttctaggacaagtgtgagggtaggaagcagtagggaggtcagtttgtactgatgatgtgcgtttaagacagtcaggtcggcctcagttggactagttcctccttcttatagtggcattgacatagcagaccagtagtctgtatggtcagcatctgcctgtgttagattaataaggcgcatggcacatgtgctcatggaatagaaattatccataggcttttgttcctatcagcaagtacaggctacaaggacagtaggatgtgacagggatgagaggtgcacattccttcgggaaagaggcacccttgggaagttgtgttcaggtgacccctttgggagcagggtctgtctgtctcactcctctgcctatggaggaaagtggagttgtcttgtagatgtaaatgactcttcctctgttctgcacagacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagagggtaggtgtcctctcctgtaccttcccctacagggtaggcttcttccacttggcctgctggtgggattcccagggactggtagacagagctagcctgtgcacatagaagtcagtgaatggagctcctgcagtatccctggtgctgcctctatagatgtgcctttcaagctctatagggtatatccccagccaacagggaaggacctggtactgaccttggttgaatgatggattgaaggacaatgaagggccatcagacagtcttttccatctagtaccatctttttttttttttcttttttctacgtttttaatttttatttatttttttctttctgtcctcacaatctgttcccatagtatcatcttagtagtcagatttggaaggcagtttctcccagggagccctttagaagcccaaagagccccatgcataatggtctctaagcatagtagaccatcaggggcctagctttgcagagtcctcagggctcgagtcctgtt

SEQ ID NO: 13411 - DNA, 1808 bp, Homo sapiens
gggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaatgtgtctagagtctttcttcatggggtctaggtagtcttctgagcccacaggggtctggccagtgaacaccagaggagtgccttcctatcagtcagccccttcttccagagggctgtggaggccccagtggccaaactcggctctgttttccctttctggctgttgggggagagggcacctgtaagtgatccctgtggaatgaag

SEQ ID NO: 13412 - DNA, 1236 bp, Homo sapiens
tggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctggggaatagaagcacagctgcagagagagaaggcagccaccacaccctgtgccccaacactggccctgtcaggctcccaggctcacctgactctgtggggctgtgctcagcatctcaaacttga

SEQ ID NO: 13413 - DNA, 1180 bp, Homo sapiens
atcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaaga

SEQ ID NO: 13414 - DNA, 2722 bp, Homo sapiens
tattggtggtacccaacttttatccgcatattcttcagcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcaccctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctcacatgcgttacgggttgattggtacatggggatggagtctcatgctgccctaagctgagagctttactcccaattcactcccttccctcgcagtgactttctcattctccctgggtacatcgacttcactgcagaccaggtggtgagtatgatcaggaattgggtcctgaacatcaaggtgagctaaggtgctactatcacctggtctctgggctaactcaccagattgggcttgggggtggattttataggatcatgttgcttgttagcatgcaggtcatacaaaagtgcctttttgtgggggactcagtaacaccttgaggtgtaagggatgctttcccacactggttgacgtttgtctcctcaggacctgacttctgctctgaccaagaaaatcactcttaagaccccactggtttcctctcccatggacacagtcacagaggctgggatggccatagcaatggcggtgagccccatggggtgtgggggaaggagcaaggactccatcgcctttccccaaaggcattcagtcctgcttcttgtcacttagtagtagtctctttttatcctgtagcttacaggcggtattggcttcatccaccacaactgtacacctgaattccaggccaatgaagttcggaaagtgaaggtcagaagggcaacgatcattagcaagcgctcctgggaattgcactgaggtggggtggggtgggagtaggggtttattctaatttagtattctttcttcccaccatggggttcagttactgagaagaccctgagattctgtttcttaaagcagcagcaatagaccaggtgtacagtgcctccagcctacccatgtctctaagatgtgttggtgtgatttggtcttgtggcactgccaaagggatcgataagcagagaccccatgcttcagatcaagagcctgatgaa

SEQ ID NO: 13415 - DNA, 2722 bp, Homo sapiens; identical to SEQ ID NO: 13414

SEQ ID NO: 13416 - DNA, 1175 bp, Homo sapiens
cattgggagtgagtgtcttggaagaagagtgggctgtgtctaaaatgcaatggtactaaagtaacaggaggacaaaatgccagaaaagtggtgtctcctgtcttggggacaagagagcaacatctgtaatagtatgttgaattcaagcctagtaacaagcagtactgaccttgtgtacataataagcaggatatgtggggtttgcccaaaaccaggcatttttagacatacgggtttcaggagttgaccctaccagacctaagcagagtggcttctgggaggaaatgggaaccagggataggcactcaagcccttctttcttggcattaggctcatatactcatgttataggccagttctgacattacaggcatgaaacattctagtagatacaagtgagcatttctatcccagcaccctgatgggcagtatctgttctgagccttccagatatggacccccaggaccttcattcatttttgaggcttccgttgcagggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaaggtaggaaacagatcttcacaagaacatgtttgagctgtgttcctattggatgtttgctagtttagttaataaattgataagcaagaagttaaaataaggaagttctctttcaggtatacagtgagttttaaaatacacatttgttgttttttttttttttttaagttttaaaaacctacacgttcactttagaaaataacagccggggccgggcgctggtggctcacgcctgtaatcccagcgctttgggaggccgaggcaggtggatcacttgaggtcaggagttgaagacgaccagcccagccaacatggtgaaaccccatccactaaaaatagaaaaatttgccaggtgtggtggtgcactgcctataatccctgctatttgggaggctgaggcatgagaatcgcttgaacccgggaggtagaggttgcaatgagctgagatcacagcattttactccagtctgggtgacagagcgagactctgtctcaaaaattaaaaaaaaaagaaaagaaaagaaaa

SEQ ID NO: 13417 - DNA, 1173 bp, Homo sapiens
caaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagtaagtgaagacttatcagtagggcaggcagcctggtccctcagggcccagtgcagcacagagcttgcctcgcaacctctggcttatttactgctgttactcttacagtgatgcagtatttagtatttgggagaagagggggagaaacatcacgtgaggctatgcaacagaaaaaagagtttatcctggtacctggaggtaaatgagatggccaggaattgctttggagttttggagacattttgggtttaagtaccatggacacttctttgtaatctcttctcaggaagagtaaagttacaggtgtagatgaatgggacacctcaagtgtgtcccagtgctgtttccttgtatcataagtaaatggttttagcaaaacacttgtagtttatcacatagattacaaactcatcactggagaggctgtgagattgttcattctgtttttcatctttgggcacacagtgt

SEQ ID NO: 13418 - DNA, 1092 bp, Homo sapiens
tggaaataaaacatatccataggaatccctgcccctagcttcctccttgcttggtgtcctctctgtgatggtcacagagcagttttgcatgtgacatttactgtccagtgcttggctctgcagagaagatgggattgacctagtgctgggtaggaagtgtgttttcagcctgtttcatccagtattgtgaagcatgtgtttgtttttttgttttcagtgtgatagttttatttaagaaatgttaatagaaataattttcaaacatccattaattgaaaaaataaggtggtataataaaactttattttttgattctatatgtatacagctgccctgaatatattccactcttgtgcaagggtaattgcttctgggcatttcctgctaaaaacagtaacataattttgacttctgtttatttctaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtatatgggaaatgctgaggtgcagcctgtttaatgtactttatttgttgtcagtgttttagttagtgggctcatcacatctatgtggatgttataggttatttaacactaagattttcaaagttaatgtggactaaaagttttttctttcttctcctttttctttaagcttttttttttttttaaacaaaccccagtgtcaaggactgactttgaatagattgcagccagggatctgcttagctacctaggaaaccccaacccagaagcgggtcatctatgattggtttagcatcaggttcaacgtgacttgcgtgatgagtgagggggcgccacc

SEQ ID NO: 13419 - DNA, 1096 bp, Homo sapiens
agtgggaggggcttactttattatattaaaggcccacctttgcctcagccaaaaagttggccttaaacaaaatggaacaacctgagaatcagtgctttaccttttttgaaattgcagaaatcccagcagaaattactaaaatctgatagtgtatcactgtaaaagtcacttttggtgtaggatttcagtccttttcagctctttttttgaccctgccgctgtgttttggtgtcaaggaagttctaggtttgttctagagaaataggcacctcttttttctaatacaaaacatctgctagtttgatttacagtcttgctcaattaagcttaaggaataggaagctaagaggaagtaaaattagccatcaaatttgataatggtggggtagttctttctaatgtactgtattgtttttaagaacaaagttaaaattattaataaaaagaggctgaggatggaaggaacttttttgttctatcttcttcagaatattagaagtcttaagaactcaggacaagcagcagaaatacatgcaacatggtgactggtgagttaaaattgttcatatcctggaagtatctgtgcacagttttttttctggtaatactgaagcattacaaatcctgtcaattctgggtgctgtcttccagaaactattaggtgctgtaaaatgaagatgtgggagaacggcatctttgaattcagccacagttcgctacttgctcagttttctcctcttaggatataagtcagtggaacccgcagatttaagcgtttgcaggctcagcttttaaacggacctaaatggttcaaagaaaagctgtaaagtttttctaggatacacttaaaattttgactttttttttttttttgagacggagtctcactctgtcacccaggctggagtgcaggggtgtgatctcggctcactgcaacctccgcctccctggttgaagcgattctcctgcctcagtttcccaagtaactgggattacaggcatgcagcaccacacctggctaattttttgtatttgtagtatagacggggtttcaccatgttgatcagactggtctcgaactcctgacctcgtgatc

SEQ ID NO: 13420 - DNA, 1102 bp, Homo sapiens
ggtctcgatctcctgatctcatgatccgcctgcctcggcctcccagagtgctgggattacaggcgtgagccactgcgcctggcctaatttttgtatttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagagtctgtgtgttatctctgcacttctagcatctgaaggccctgaagacatgctggtggtggtggtatgattgggggatggagatgtgccttttgcacattttgtctgtgagaatggactttcccagaacagagtggtactgacagctttgaaagcaccggtgcactttttggtgcttaaaggcaggggcctgggtaggattcataccctccgcacctggtctgagagaatggagggccctggggtgtttgtccatggttaggacccctgtgccagagggatctaaaaggtttgtttctgctggtgtggagaggcctagctcccagtctgatcattcagcatataattttttttttttttttttgatacggagttccactctagcccaggctggagtgcagtggctcaatcttggctcactgcaacctctgcct

SEQ ID NO: 13421 - DNA, 2278 bp, Homo sapiens
atgagatgctcctgtgcttagagacagcctgagtccttgttcccctcaggcaatgcgcaagggcaagttttcagagggcgaggccacactacggatgaagctggtgatggaggatggcaagatggaccctgtagcctatcgagtcaagtatacaccacaccaccgcacaggggacaaatggtgggtgtagaatggggtggggtggtggggctgccgagcagggcgatgggccatggggtagggcagagtagggctggatggtagggcccactgcctatgccccacaggtgcatctatcccacctacgactacacacactgcctctgtgactccatcgagcacatcactcactcactctgcaccaaggaattccaggcccggtgagggagctgggtccatggggtggtagggccagtggaattccagcagcccttcctgtggtctctgcctggttccagagctggccagtgctaaccctactctcccaccccagacgctcttcctacttctggctttgcaatgcactggacgtctattgccctgtgcagtgggagtatggccgcctcaacctgcactatgctgttgtctctaagaggaagatcctccagcttgtagcaactggtgctgtgcggtaggtgcggctgtttggcttatgaaaggttaatggcatatgctcccaaaggccttctcaccaccttcttatccacagggactgggatgacccacggctctttacactcacggccctgcgacggcggggcttcccacctgaggccatcaacaacttctgtgcccgggtatagcccagcaggttgggtagatacattgggggttgagtgtggcagtttgtgattgtagctgtgactgatgctgaactttcctgccaggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaaggtgggcctgcctcaacatgtgtgtcacatgtgtgtgtgtagctgggggtacacttggctctgggcatgggggtcctaatgctgagtatgactcatacctgtctcctgtctcctgctatagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatgtgagtatagcctgcagtcctggttgtggttcccgggtctaattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcaggcatcactacacgtggtggatgcagcattagtggactgctctgtggccctggcaaaacccttcgacaagttccagtttgagcgtcttggatatttctccgtggatccagacagccatcagggaaaggtgcttgactttactcacctgccctcatctgcagcagtgacagtggctgccgttcattgtgccaagtgctctgcatacattcccttagttaatcctcaccacctgagggagttggtattcatattctac

SEQ ID NO: 13422 - DNA, 1272 bp, Homo sapiens
agaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctactcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgcagcctggtccttaggcttattctggtcctggcaggtgagaactacaagaccccaggctatgtggtcactccacacaccatgaatctactaaagcagcacctggagattactggtgggcaggtgtgtggggatgtggccatgtgagcttgtgccatcaaacacctgcctgagtgcctgggctgcgtccatactgccccatctcacccatcaccatggccttcctgggagggaacatctgtttctttaaggtcatctgagctcagactttatttctcttttcccatcccccttattttaggtacgtacccggttcccgccagaacccaatggaatcctgcatattggacatgccaaagccatcaatttcaactttggctatgccaaggtaagcatgtgtctagggacctggcaagcaagatgaccacttgctgttcccatgagtggataccatatccctgccttgctgtctgctcccaataatgtacccaggtgggcagaggccatggaaaggaaccacatgtgtgacagatacctaggaatctattgagcttattggaataaatagctccctccctctgaggagtcagtgagttcaaatttgggggagttgccagtgcagtccctaggcttagaaagatgctaggttagatacaggaaggtgagagaagctcttgaagacatttttaattctgacatgagtccgggttgggtggctcacgcctgtaatctcaacacttcgggaggctaaagtgggtggatcacttgaggtcag

SEQ ID NO: 13423 - DNA, 1102 bp, Homo sapiens
cacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgagactggagcagctatgagtgggttggttggtgggcaggcttcccagggatgacacatttcttcttcctcctccctgcaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcgtgggatcagggtgagttggctgggctgagcactcacagcttcctcttaaccgtgggcagggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgt

SEQ ID NO: 13424 - DNA, 1118 bp, Homo sapiens
aatcgcttgaacccgggaggtggaggttgcagtgagccaagatcgcgtcactgcgctccagcttgtgtgacagagcaagactgtgtctcagaaaaaaaagaaaaaagaaaaaaaagaaagttgaggccgggcttggtggccaacacctgtaatcccagcactttgggatgctgaggcgggaggattgctcgaggccaggagtttgagaccctgtctctacaaaaaataaaaataaaataaaaaggtaggaccagatggcaatttgaatttgtataatttcagcagttcttcagaaagtactctaaagaattaagaataaaatgaagcaatgtttggaagagaaagagatggcctagcccccatgctgctgcctgtgtattgaggaggatgctgacatagaggtcctgcttatttgctctgcttctgactcatctgtaccctgacctcaccatacattgtttctagaagggctcctctgcccctagtgatgcctgcttctcctaatgcatttcgcaccctttgtggggcacccctgtgaccttgaccatctctgtcttgcagtaccgtgtgactgtgccgctgatgggggctgtgtccgacctgtgcgaggctctctccaggctgtctggcattgctgcagaaaatgtaaggcggggtgatcagtggcactcggtctatttgggatacttcatagcatttggagtttactttcaaccttgaagccactttttggggttgttgttattgccagcacaaatgtgattatttgtgtgtgtctggatgcctcactcactatgcacattgtgactgagactgtcccttccagctccaggaaacactatctttccttcattgggttcacactagccgtggtcaaaggaccaggagtagggctctgctgtcagatctgtgcactgagggtggcatagagactgcagactatggaatactccagaggctctggacaactgctggtttctggttagcaccacactcctcgcccttcctgccagtcgagggcagatgctaccagcatgttcaattctgatggcagccatgctgctcccccttgggccttggccctcagctctctggggctgtttgtgtggtggtttctc

SEQ ID NO: 13425 - DNA, 1821 bp, Homo sapiens
acctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgtgatccacccgcctcggcctcccaaagtgctgggattacaggtatgagccaccgcacccggcctggcgatactttttctaacctcattgtc

SEQ ID NO: 13426 - DNA, 1947 bp, Homo sapiens
cagcctggccaaaatggtgaaaccccatctctactaaaaaattacttgggcgtggtggtgggcacctgtagtcccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgca

SEQ ID NO: 13427 - DNA, 1106 bp, Homo sapiens
ccgccatgactggccctcgccccacccggggtactgtcaccgtagtccccaccacgcacgcgtgtggtcttccgggaccaggcccgttagtgcgcacgcgtaaacccagccagggtggggcctacttcgcgtgcgtgaagagttggcagttcggggaggagtattaaaaccgcgcacgcgcacctaaccccaccctgcttgcttaagggatgagtgactccgggagtacaaaatagcaaccaggtcttttatagccccggagttcccgtgatgccccacgcggctgcaatgattggttaagggttttgcttttagggcgtggacgggctcctgagcaatagtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgaggtgagcggaagggttccctccaggcgccgcggggccccaggcccgccagcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccggtagtctcctgtgccccttcccccgcccggccgggcctggtggagcccaggctgcccgcctgcccgccctcggtccccggagcttcctctcccagcggcgccgggcagggcgggggctttgggccgggccccgcgaccgcgcagtgtagccggccgctgaaagcgcgcgtggctgtcggagttgaaatgggaaagaaactctttacaactccattttgctttttacgtttaacgagaaacgacaatcactgtttcatattgattaaagtccagttacac

SEQ ID NO: 13428 - DNA, 1113 bp, Homo sapiens
cttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggtgagctgggccagcactaaaggatagggtcctggaggtcagggtgacccttgataagactagccagcccatgactcatccaaaggttatgtagcctgaagccttcctgagcctcccttccctgaaggtgccactgtgcctttgcccattagaaactgcagatgttggccggatgcggtggctcacatctgtaatcccagcactttgggaggccgaggcgggtggatcacgaggtcaggagatcaagaccatcctggctaacatggtgaaaccccgtctctactaaaaatacaaaaaaaaaattagctgggcattgtggcgggcgcctgtagtcccagctactcgggaggctgaggcaggagaatggcatgaacctgggcggcggagtttgcagtgagccgagattgcgccactgcacctccagccagggcgatagagcgagaccccgtctcaaaaaaaaaaaaaaaaaaaaaaaagaaactgaagatgctgccgggcatggtggc

SEQ ID NO: 13429 - DNA, 1128 bp, Homo sapiens
ggggagcacactggccatctgatcaggccttcctccctgtttacagtggtccactccttggctttgtttgctgtgaactggattccaaggacagccttctcagaagagctagaggtcatgggggtgtcatggataggtcaatggccccaaggaaatgagctcagagggtctcatcatctcatccttctagcttgcccccattaaatggtgtgccttaatgtcccgggttttccagggctgacacccactctcatgtattgggctggatgttggtttgaaaaggggttatttcaggaaggtgctaggtcctgtccagttccctggcagtccccccacacagagtgactgggggaggtcaggaaatcagaaggtggtcctttgccacgtgtagaaccaaaagactggttagtcactttgggtgggctggactgcactgtggatggcagggaggatgcatccttgcttagtagccttttggattgtagctgttgcaatggcctgaggctttcaatctcttccccagaccaagatacttggtagtgaccgggtgaagctgatggagagtctagtggttggagacattgcagagctaagaccaaaccaggtgggcccttttatttctgctctatgagttttcttagtcatgagccagcaaatgggctgagtccctacctcaggcttaggggcacagagatgagtcaaacacagcttctcagggcttgcagtcttggacagaatccctgagtcatttccagagacacagacatttgtagggaggggaatatcccagtcttactacatcaggctaggaggccagaaaccaaggttaatatgctgctctctggccatcccttctgcttaacccctctctattcaacatgtggtccctggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggctgaggttgcagcaagctgaggttgcaccactgcactctggcctgggcaacagagt

SEQ ID NO: 13430 - DNA, 1221 bp, Homo sapiens
ctgtgggctccctaaacagggttttcccagtgtctgaggcccagcggcccttctctctgctcctaggaccttggaatctggtcccagagctgtccactttgtctcactcagggcagtacatctttgctttgcagagcccctccgtgacctttcccaagtggctctcccacccagtgccctgtgagcaacctgcactcctccgtgaggtaagccctcaccctaggtaagaaccatgtgtgaatggctctagtgtccaacacaggccaggtagaccccttcctgtaaaattctggggctgggcccagggcccttgggtgttatcttcctcctgggtattctgtgggatttgaggcatctctgttgtggggctacatcaggccctaacctcatgtttcataagccatctgagaatgttgttggtctcagctggagggcccctagcccaggttggcctctctggagcctgaagggcactgctggggagagacccatggccactgacccctccttctggagcagggtctcccagaccccagcagggtatcctccgaggtgcagcagatgtgggcactgacagagatgatccgggccagtcacacctccgcaaggatcggccgctttgatgtaagtaatcgcttccttctgcttggcttgctttgccctgagcagatcagacctgatggtcttttgtatttcaggtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatt

SEQ ID NO: 13431 - DNA, 1170 bp, Homo sapiens
gcagggcgtgtcactgttataaaatccacaacagtcgtgagctccatggcatcagttcttgggaatgagacatgtgcttgagtgccagcactgctgtctccccactgtgtggccttgggtgagatatttgcctcccaagttagcccatctcatagccctagtcttgtgacaggtaaataaactcagttgtgtctctctaggggggaggaatcagcttccccagcaggcattctgaattataccttaaacctgtcacacaattcaggttaactgttgtgatcatattcaggttatgcagtgacaatagtatttttaatttatgcttgtgtctcttctaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactc

SEQ ID NO: 13432 - DNA, 2308 bp, Homo sapiens
agttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgttgcatctgggcatctgtttccctggcatctggagaggttcctggacatgaggggttgggggctcatgtgacggggaagaggagactcagccaggtccacttggggttggcccagtggcctccatgtaagccttaccatttctgtgctgggagggctgggtgtgcactccagaaactctgccaacatgtaatgcccccttcacccctcttctgcctgtgaatcagctaagacaagtctcctacatcctcagttcctcctctgtaaggggtgggggatagcagagaaaccagtgagactggctgggaaggaggatggtgggaaagtgtcacgggttttctgccccagagtgtgtcagcccct

SEQ ID NO: 13433 - DNA, 1196 bp, Homo sapiens
gccatcaaggtgctcgtggtcaatccacgaaggcccggcagggcagccctggggctcagtgtgctcccttcccatactgtgcctgtcagacctggggaggcactagcttttaggaagcagagcaggtcctatagacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgagg

SEQ ID NO: 13434 - DNA, 1232 bp, Homo sapiens
ggcatacaccacaggtccctgcccttccctcctctacctcaaattctcatggagccccgtagccccagaattcctggggctgcaacagctcggtgtcttgcaggtgcgtggtggaggctggctttcctttcagcagtgactgcctgccagacctcagcgtgtgggctgagatgctggacaaatcgcccatcagatacatccctcaggtatgcagccccctccttgccctgtgtgctgcccatccatccagaatccagggcccagctcaacacagctccccactcttccccaaacacccaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacatggc

SEQ ID NO: 13435 - DNA, 1153 bp, Homo sapiens
gaacttgctgagggtcaggctgtggctgtgtggctgctctggacctggagtggatggtgtggtgtcagggctggacacagctgcagcctggggcttgcctagtagaaggaggggacagattctgtcccaactaactccaaggcagctgtcctctgtcccctgctttcatgacctgagcattcctagggagccatctttctgtccttataccaaagcctcaatgggcgaggacagaggcaaacaggcagaggccactgcagtggagtccctgatgatgccgcctcctgtccccctgcagagccctgcccttccaccctgctgcagcagcacatggcggacctcctacagcagggtcctgatgtggcacccagcttcctcaacagcgtcctcaatcagctcaactgggccttctctgaattcattggcatgatccaagaggtgggctgtggtggggcctcgtgggttagggtggtgcaagggatgaggcctggtcctgggctagagccaggtgctgaccactgcatgcccacgtgttggtggctcagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacaggtgtggccatctgggcaacaagggtgggaccctggggatgccccattgatgacgctccccatccaccaatggactcctgctcccctcacagctgctaaaccaggtgctgaaccgggtgacagctgagaggaacctgtttgatcgtgtggtcaccctacggctgcctggtgaggacctagatgccctgcaccccaacacactacaggcctcggttcctctgctaggaacagtgaggcctgattccacattctgcccccggacagccagacttggtgctctgcagtctcggctcacccttctgtagagagggcagtgggcaggcctggagcccttgaagcaggagcatgtgggtggctcatctctttcctccccttcccctcaggcctagagagcgtggaccactatcccattctggtggc

SEQ ID NO: 13436 - DNA, 3649 bp, Homo sapiens
accagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaggcgagtctgtctttgtgaaaatcccgtggcccgggagccttccctggtcaccctcggggcgaggccggggccgtggggcggggccggcggctgctggaccgcggcgaagcagggaacaaggcctcgcccttggcgccagttccgcctttggatccgccaatggccagctgacccgcgggtcccggcccgggtctccatggcagcccggcgtactcgggcgctcattggctacgtctgtcgcagcgctgcgctccaacgttccgacgccggcggccgtgccacgtacgcgg

SEQ ID NO: 13437 - DNA, 1193 bp, Homo sapiens
ctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcatcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgaggctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttggatggtgaggcctgggtttgtgctctggacttcttcagccacctgcacaacatgtaccatgaggcccagaccactggaccttggcagcccacagtgggcctgtaaatgctggcagtgggctgtgtctactgtaagatacctttcaggaggaagcaggcagggaggtgaagaagcagctgg

SEQ ID NO: 13438 - DNA, 1202 bp, Homo sapiens
agggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccaccgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacact

SEQ ID NO: 13439 - DNA, 1197 bp, Homo sapiens
gatcctttcttctcttccttttctcttcttttttttttgagacggagtctcgctctgttgcccaggctggagtgcggtggcgttatctcggttcactgtgagctctgcctcccaggttcacgccattctcctgccttagcctcacaagtagctggaactacaggtgcctgccaccactcccggctaattttttgtatttttagtagagacggggtttcaccgtgttagccaggatggtctcaatctcctgacctcgtgatcggctcgccttttccttccaaagtgctgggattacaggcctgagccactgcacccggcctcttctctttttcttagccatgatacagaatccttaactttgtatatcacatctagtagaattataagaaaatgaaaatgtcacagattccagggtacttagtggaagttagcttatgaagaactgacatatacaatgacagaagaaggctagattgggcattacaaataaagatgtttgggttggcgttcagtgccttggctttccctaacacttgtgtttatcatcaggcacagcagtgaccaccacctcagcggctgtagtgtcccagagtcctcagctgtataatcaaacctccaatccacctggctctccggtaatcctgttgtcctatatacaaaactcgtggctgatggggaaattttgttttgctatacaagtattaccctttcctgttgtatgagccaggattgagtaatacacacttcaaccttatttctttctgttgttttaaaatattaattttatgatatatatgtgcatgtatattttaaatataaaatttcaactgtgtatttacactttatgcatgcttgacctttagaaagttgtcgccggggccgggtgtggtggctcgcgcctgtaatcccagcactttgggaggccgaggcgggtggatcacgaggttaggagatcaagaccatcctggctaacacggtgaaaccccgtctctactaaaaatacaaaaattagccgggcgtggtggcacatgcctgtaatcccagctactcgggaggctgaggcaggagaattgcttgaaccccggagacggaggttgcagtgagccaagattgcgccactgcagtccagtttgggcaacagagcaagactcctcttgaaaaagaaagcaaaaaagttgtcaacatgtgttttgctga

SEQ ID NO: 13440 - DNA, 1102 bp, Homo sapiens
cctccagagggttgcttcttgtcccaagtagcctatggtgaccaggtggccctcaggcgccccccactggacagaagtgtaaccttggaacactggcaggggctggtgcctcacttaggcttgtatagttgtgtgtgcacacatgaagcccttaacacactcaagcatgtacccctgaacatgtgtacatgggcatcctccttcacacagtggggtacccctttgcacatctggcatgtatgggcagccacaaacattgtcatattatgcacatgcatgcacaggttgtatgcctggccgtccacacgcacagacccttgctgcacacgtaggatgcggcctgcctgccacacatgcagcacaagtcttcattttctctcccccaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatggtgagccagaggggctgtggcagggtgctggggaagaactaagcgggcctggagccccagcagggggttctgggggtgggtaggggggtgaacctggagggggaggggcaataggtgaccaggggacaagggaggagaaggcccagggtgtgaatcaggaggtcaagtgagtgaggtgcagggcatggaggaggtcatacaagcaggcctggcccagtggtccagacagaagggcctggccttgccctgggacagaaccagaggccatcctgatgttccctggagaaatctcacctcctcacccaccaggccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctcccccacgt

SEQ ID NO: 13441 - DNA, 1359 bp, Homo sapiens
tgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaataccgagaactgatgggtattctctcccaggggcagaggcctgggctaaggtgtgccaaggtgatggtggtcctaacctcagtcctcaacctgagtcagggccctgactcagctttccgggccgtcctggagccccacgctctgagcttcatttctcccacctggactaggcagcatacatgtggggcccgtgtgtccccgcccttccagtactctgcagccttgggtctcgggcagctgggcaggcttctaagggagctgttgtaaggtgctcttccacacctggagcaggaggggtggccggcctctctagcgcggaaggagaaagtgacttccgacttaggtaccaaggcctgagagtgtccgttgccaaggccacacagccaggtgggccgcatgcagtcctggcttgactaaaaaggccagtaggggccttaagacatattcagaaagttccctgccccagagggccgccgccaaacctgaagggta

SEQ ID NO: 13442 - DNA, 1313 bp, Homo sapiens
catcccagaggccagcatcaacatgtcagtaccgcacccttcccatttgctgcctgtaggtccaccccgcgcgtgcggtccccaagtggccatgccaccctgcacgccctccccgcgtcagtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggtgaggggcttacagccctgtgaatggtgtgggaggtgaggggaggggggtgcctgttactgaccagtgtttaattggcctcaagctcaggagaggtaaggggagccaggaggccccctctggagcaggtgagtagaaggagggggctcagctgcccgcccacgactagaaaacccccagcatagacctgccggacggcaggaccttggttaagatgggaaaacagtagggtttgggcacaggaggtctgggcccccaacctggtgaccgttggacaccctgtggatataggaaggaagctgtggtccttatctagggtgcctgcgaaactcaagccagtggggaaccaagcctgcagaggcaatactgctgtgtgactgtgggccaggcccagtgctggtgctgctggggccccatctgaggagacagttgggtctatatccaaagtgtcctgagatgggcagagttgggaagggggccatgggctccaggtggggaaggcagtcaagacaggccaaagctcagcctgatgggtgcatgagtggggccccaggatccactaaggcagtgggcatagcccaggtagttgaaaaggctgggagctggaggagactcggaacatagggagaagaaagggacaggaagactcccgggcagtttttcctatggagggaaccttgggtaggtttgagcagggggtatagtgtctgctttgcatcttctatcccatgccctagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccc

SEQ ID NO: 13443 - DNA, 1313 bp, Homo sapiens; identical to SEQ ID NO: 13442

SEQ ID NO: 13444 - DNA, 1147 bp, Homo sapiens
tacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgaggtatgtgtctccagggccctgccttttttctccttccttgaggatccactgcacatttgggttatcaggggccactataggactatacctgtagtttattggctgctccacatcccctcaaatcattctgtctataacctgaaagggtgacatcattatccccatttttcagatgagaacaattgaggcacagcgatgctgagaagtttgcccaaagcttcccagcaaatccagagcagagctgggactggg

SEQ ID NO: 13445 - DNA, 1171 bp, Homo sapiens
cactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacaca

SEQ ID NO: 13446 - DNA, 1099 bp, Homo sapiens
ctcctggggtctggggtctgagcaaccagggccttctcccctgagcaacctcagatggggctgtccttctagccctgtaggattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttgcttccccttttgtgaatgaaggtagcaccttgggtttctctatatttggcccatgttagtgggcaaggcccgggtctttttataaatggacctggctccttctgcactgggatggagtcggggagtctggctgaagatcaccttggggctctgctcctgcctggttcctaactccaaaccaatgttttctctttctggcccagcctgaaaacctactctacacatctaaggagaaagacgcagtgcttaagctcaccgattttggctttgctaaggagaccacccaaaatgccctgcagacaccctgctatactccctattatgtgggtgagtccttcggacatgagttgtaactcctcaccccaacttatacagctgtattatggggtagccagtgggttgcagaaaccaaagggttaaagcccagcaaggagggagggggagaattctgtctgcatggaggcgggtgacgtggggggccggaggctgcaaaaatattctcccaaacttcagcttctgcttttgaaaatagatccaggaaaattctggctgtggcctgtgagctgaatgacatcacagcagctctaaatatatatgtgataaaaggctgccatcagcttgggacggagcccaaccgcggttgtttttctctagtttttgtcttcctgggattcatattcagaaagtgggcatgcatttcctcctaacttggagggacaaagggtaccagtcacctgccttgtgggagacggtcactaaagccagggcttggaggtgtgcacatactcatgcttcctggaaaagttcactgcccttctgcaagtgggcaaccccc

SEQ ID NO: 13447 - DNA, 1349 bp, Homo sapiens
cttagtgcccaccatcctgtctgtccccaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctggg

SEQ ID NO: 13448 - DNA, 1135 bp, Homo sapiens
gtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaag

SEQ ID NO: 13449 - DNA, 1740 bp, Homo sapiens
gcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggt

SEQ ID NO: 13450 - DNA, 1226 bp, Homo sapiens
tccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgtgggccagggaggaaaaccagagcacacagttttgtcac

SEQ ID NO: 13451 - DNA, 1816 bp, Homo sapiens
tcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagg

SEQ ID NO: 13452 - DNA, 1368 bp, Homo sapiens
tcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgtttatggcctttccctattttcttttaccgaagtggggtgtgtcccttttttgcagctctagccaggccatagagaagacaccttccaggagaggcaaggagagcatgttctgcccacatagagcactccagggaggaaagtagcttatactcacagtgtctgcccctgccgtgtagctctctcatggggagggcctgtttttgtaagggtaatgtggagagagaggtcagggctttgttccctgtggacgcagctctctgttgtcatgttctggatccagcaggctgctcccaagtacagatttggtagaactggaaagggaggtattctgggaagttttggaggatggagttggcaaagctaaggagtgaaagcatttcggccgtctctgtagctggggcagcggccactaatgttttctg

SEQ ID NO: 13453 - DNA, 1121 bp, Homo sapiens
cattacttcacatatgggcttttgactcaagaattgtggaatttgaaaggtattattatttaatttataattaaaaccttggccaagcatggtggctcatgcctgtaattccagcacttgaggaggctgaggtgggaggatcgcttgagtctaggagttcagggctgcagtgagctatgatcatgccactgcactccagcatgggcaacaaaatgagaccctgtctctacaaaaaataaaataattagctgggtgtggtggcatgtgcctgtggttctagctacttgggatgctgagacaggagggcagcttgagcctgggagattgaggctacagtgagccgtgatcaagccactgccctccagcctgggcagcaaagtgagaccctgtcttgaaataagtaaataaaataaaatctcttggccagtgagctgtgctcaaggaggtagtaggcagatgtagagttatatataataataatactatatatctctccttataggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggtgggaccagagagagatttcaaatgaagtttgatgcatctttttgttaaagttgatgttggtttgcacattgtatatgcttaacaaacatttgttgaattgaattgaaattttggacttgaatctgagaaattagattaggcatgaaaatatgatttttaatttacagcacacttgttcatatatatggtcttggtgattgtaaaatttgcataataggcaaggattagcctctgtactgtcggagaaggtacatgatttacacggccacagctgcagagctggggttaaagtcttgtcttgagcctggagtccaggattctttagtacttaaagtgtcttgctactacttgacaaccatatataatgtttatattacgttcatataaaattgtccttttactcttggaattcgacatactgttaggattttcacaaattagtttaag

SEQ ID NO: 13454 - DNA, 1205 bp, Homo sapiens
agagatgtttgagctatgcagagtcactaaaacatgtctcagagccagaacactcatagggaaggtggtgatttggatacggttagcttgccttgcttagagaagttccggggaattcatgttcagcatttttttctttgtttttcttttggagagagtctcacctcgtcgctcaggctggaatgcagtggcgccatcttggctcactgcaacctctgcctccccggttcaagcaattctcatgcctcagccacctgagtagctgggattacaggtgtgtgccaccatgcctgactaacttttgtatttttagtagagatgggttttcaccatgttggccaggctggtctcgaactcctgacctcaagtgatccacccaccttgacctcccaaagtgctgggattacaggcatgagccactgtgcccagctagcatttttttctttgaaagacttgtgttcctaagcaaaacccttggtgattctgatgcctttcatcctctcctagcacccctgcagtggaccatgagtcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatggtaagtgggctctattgagtgacagaagttgccttatattttcctccagtggaatttttgctgggagaccttggcgtttccagttagatttcttaggccatccatagtgggaagatacagactaggaactgagatgcaatgaattcagatgctcattcctaggaaatagattattgttcctccacataagctttgttttactgctggaagaacctttagcctttagcttgtctctgacagatgtttggactcaggtccagagattcgagtgttgcatacttgcccaggtcatggaggagtcaatggcagagttcctatggtaagactttgcagtctggaggccatgggctcttcaggtagatgtgagggtaactgtgagtggtctgtaagttttctgaaattatacatacaattgtgcttgtgtgtacatgagggaattgtccaggcagagattcttagacagattcacaacttcagaaagctcactgcatctcctgcagtgctg

SEQ ID NO: 13455 - DNA, 1099 bp, Homo sapiens
tgtactcttgacagaaagacagtaaacctgcctgtgtatctctgagcagtctcttcgctagtgctggagacagccagctcttttcttggtcctaaagtaaggctcattatctatcagccatgttggtaactaaatcaacatcctcctgtgtccccaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggtgagttgctgaaaggggagggtctgctgctgggccaggcacaaacacctttcaacttgttcatattttaaataaaggcagagcctacaacttgttccttgactgctgtgaattgacaggctctgctctagggtaggtgtgaaagcagttcagtagccctggtgttttaaatggttctggttttgactgccctagctggaaaagtgagctgctggcccgtgacccaggagagtctttctggacacctgggtaggagacggggataaagcttcccagaaagaggcccagccattccacacaggtgcatctgacccctagcaccttagtcctaggcctcacttagaagtggtgttcaaggatgaaggctctgttcccttggattacagtcagggaatcctgctgctcctaaggggattccattctgtgtctgtgccatgatctggaaccaaaaaatctcttttttgagtataacatctagacttgttcagaatattaacagaatagaagccaagtgctaagcagtgagagaggctccttgtaagatattatagaacagttatctaggtttaattttttttttttaatttcaagacagtgcctcacagctctcaccctccacttactgatcagatctgctacctgattcagtagtttgcatttttaattatttgattatcttgaattaaaaataattattttatttgatgggaacagatttaaattttctctttctttttttgtgaca

SEQ ID NO: 13456 - DNA, 3216 bp, Homo sapiens
aatttggggaaattcatgagagaaaatgggcattaccaatctatgtctcttaaccccggtggctatctctgagcagctctccctttccagcttggaaggttgtctgtgtgcagaggctgggagggagaagcactgcagtacgtgaatgaaaggtcgcagagttgtggctggaaaatacatttttcaccagggtagaactgagcccccagctgcctatcctggtagtcttttctgttcctttccttcccctttagagagctccatgttaatttatttcttatgggcaattatttattacttggacttttcatgtgtcttgtttatttgggggtggggggaggttaggggtaaggagggtaggtgatagaaagggaagttttaagatatcccagaccctatagccactggtgaaaaacaatcctggatggatggtaaattgaccaggggaagagttaggtttgaccaaggtttggattaaacaactatatttttgagagatggcttttcaggaagatcagggaatcctgagactggatagttagtggagggtgggactcattccacagaaatcgaaagttgtgatcatggagtttgcaattgggaagtaagagaccccagatttggagctgtgtcctcctgggatgatgttagatgttggctctctatgctgaatagtgaagctgtggataggcggttgctgggttgagggactgttgatttcatgttcgaaaatatcttcaggtggtccatgtaggcctggtgtctgctgcctccatctttgaaggaacatggaggagccctttctctgtaggagccctaagtctgggttttatcttaaaagaacacaccagtcattctgggtctccccttattgccattgccaggggagggtcgtctagtccttaagcataaacactggctgtcttcctactggtgtccccgccccctctgtatcccccaccccaacactttgccagacagttctttatgatgaacaaactttggctttagagctttaccacttacccatggctccctccttactgggcaggtggtgtacctgcctcttcccagcccagaaggcagcttagtcaggtcatcccagtagtagctcctacagctcttctgaccagcccatttccatctttggagggccttagcagactctggggtattgtcctcagagaagagacaaggagatgatggatggggtgcatgtgtatatgtgtgtttgtctgctgtccaataacaccaaaagtggaacttaagaagctttgtgttttcataagcaccctgccagacacttaactcttctactcatggaagccttagatctacaatttagctatgcaaattattttaataatttaaaaatagcagttccaaccagtgctttctctttcagatgcatcccaagaatggatggtgaagggactcagttggagtgagctctcaggttgaggctggtgcagtaggagtgagctagactgaatctccaatttatgggacacactcagaacctgggttacactgatgcctctcaggccctggagcactgggatcccagagatgcatgtgtgcatgtgtatgtctgtgtgtgtgtgttgtcgggagaagggggtagtatttctgtgttcacttctaggaaatcactgtactagcctccaagaatccggaaaccttcccagccgggaactgaaaccattccctggagggatgggcttggcttttgaagttgacagaaagtaaatgggtattctgagaggcagcacatgcctactgtctatccagtgttccagggactgggtcttgcttctactcagcagaggccatcattctgggaggctgacctgactagagaaggctttcttttatatgtgcagtttctattgtgtagaggggttgggggtgggatcatgggaaattggagtgctaccaggtccatggtttttgctttttttttttttttttttttttttttttttttttaaagaaaataacctgaaaacacttctgacttttccactgtctctttatatgtgctgataggcaaatgtgcatgcacaccaaacataagcatgtttgtgagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttccttttttttttttttgagacagagtcttgctctgtcacccaggcttgagtgcaatggtgtgatcttggctccgtgcaacctccactcccggtttcaagcgatcctcctgcctcagcctcccaagtagctgggattacaggtgcacaccaccatgcccagctaatttgtatattttttagtagagacggggtttcaccacgttggccaggctggccttgaactcctgacctcaagtgatccaccctcctcggcctcccagtgatgggat

SEQ ID NO: 13457 - DNA, 1232 bp, Homo sapiens
gccccctgagcccgggaggctgcattattcatgagtgcactgcgtgctgagttgcctctccctggaggagggggtggggtggtcctagctaacctgtgctcccttttcctggtcataggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctggatttgggttgtgtatttgtttgttctgccttggttgggggcggtggggggatggctgtacagataggctgggagtgggaaggagcctcccctccccaggacaaagaatggaaggaacatggcaggtaccctggggttgggggaggaggggagttagagatcctccacgtcctgctctgtgaccccagtggccagctgcccctccattgcagctgccagagagcaagcagagcctggcttgggtgagagctgagtatggggtgcccttcagggctcaggaatggggagctcacagcctgtcttcatctgcctccaagggatgcctttgtgtctgtgactagtgtgcctgcacgctggtacttccccagtaggcgaggctcccccactgtgcctgccagtggctgtgtacctgtgtgtgtgcatgtgcacccacgctcatgcatttggctctgtgtaaccacggatggatggggctgcttgggtaaagctgtgcccaggtgagcatcagggtatgat

SEQ ID NO: 13458 - DNA, 2150 bp, Homo sapiens
cttttcatggatgaggatgatgaggcagagagctcagatggccttgtccgggctgtgtgcccttgatcccttcctgtcatgtggccttttttctttttttttagaattaaaaaaaatttgttgtgggtgcttagtaggtgtacgtatttgtggggtacttgagatgttttgatacaggcatgcaatatgtaataatcacatcatgggaaatggggtatccatcccctcaagcattaatcctttgtgttacacagggggccttttctgcctctggccccctcactgctgtattccctccctgtttatagctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggtgggtgccctgagaggcagggaggaggggtcgccgggtgggccggtgcaggggttgctcactgttccagtctccccaggctcccacagctcctgtgtgcggctttggcagtgtggggaaggcttccggcagcttgaccttctctgtgacatccccctggtgagtgagtgtgcttgaatgctcagcctgtctctgccacactgcctaggcccctggagttagctctttaaggtctttcttcctgccagaagggaaccttctcagggcagggccagctcctagcacagggcctggcaggaaccctccccactttccctcctctgctccccttcctatcctaggccctgtccagggtgctggggtacaagtcagggagcagcatggggagaggcatggaggcctggccctgtgatgaattctgtactgctggtgccagattgggtgccaggctagagggtgtggacctcactgtccacactagggtgacctgggggagggtggcaggatctgtcagtgatgtgtgctgagaatgcagggtctaggtcagtggggacagtcatggggtctccagggccccaccaccaggagccagcctcaggccatactgggtgtacactgcctccttcatcctcacaaactcactgctagccccgtgctctgcttacccccatctcgcagatgtggaggctgaggccctgacaagtgaagggctggcctgtgtcaccaggtggcaggaggcagagcagggatttaacccaggcctgataaggcccagcccttgactgtgatgctgaggacggtggtggcggggggcgttctaatgtctttccgtgttgtctttctgctcaggtgggttttatcaacagcctcaagttctccagctctggggacttcctggtggctggggtagggcaggagcacaggtatgtgtggccctcgagggttcaggtaaggtggtgcaggctggacagctcggtggaaatggggtggagactgggccgagtctcagctgcgtcttgcactccctgcaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttgggccttgtttcttgtagcttcttggtgggggtgggggtgcatgagggactgggtgggaggcggcctggggagggacaggactccagcagtctcctagctctgcccctctgctagcctgagggctgttatccttttccaaagaacttgggatggagacctcaactggctcctggctcctgtccctgcgtgtcctgcacgacctcctcaggctagctgcctgccactgctctgggtggtcggggtcagaagctactcacccctcagctcagaagccagggcttgtaagggctggtgctggggtcaggactggactgtagacagcggacctgcacatcaaactggcttcgcttcctctcccaggtcaggtcaggaagctggaggggacagactgccgtgaggtgtgggggtcaggagtgggagtgggaccctgcactggtgggcttactgtttggagacaggggtccaagttgggaagagctctgtctttggtctgaatg

SEQ ID NO: 13459 - DNA, 1111 bp, Homo sapiens
gtggggaagtctctggaggcaggtttgctgccctaggagtgctctctgggtgacagtgaaagctgctgcccggcagtggggcttatgagctccctgtccctagagacctttgggcaaagtcaggatgatgatttaatgggaattaatgctgcaggtaggtggttggactagaagacatttgaggctgtgcagtcctgggattgagtgcccggtcctcctgggttcccatccgttgctggctgaccagcggttccttctacacccgctgtagtaacagaagaactcacaccatcaatcccaaagcccttttacatcccttctcttttttgggctttgtggctgctgtttggcactaatgtccctcttcatagatgaggaaactgaggcagcttgtccggaggctcacggtggctgagccaggtcttctggccgagtccgggacatttgccatggctcttttttccatgctgccccttgaggggggttgccagccagccctatccccccatcccagtagcttctcccccacccccaactgcagggagcgtggagagtggacggaagctgcatgtgattcctcgagccaagaagggtgccgagggaaagccccctggccacagcagccacgtcctctgcatggccatctcctccgacggcaagtaccttgtaaggccaggttggccctgggggcaggcgggaggtctggtgcatggtgggtgcctgtgatcattgtcttcatccctgcaggcctctggtgaccgcagcaagctcattctcatttgggaggcccagagctgccagcacttgtacaccttcacaggacaccgggatgcagtgtcggtgaggagctgggtctatgtcagtggatctttagtgggcacatgctagtgttctaggctcagtgctggcctctggagtctctgtcctcagggaacctgcatcctggggtagcgagtgggtagcgagtggtgctgtaaaatacataaatgggctaaagggatggggaggagctgggggagaccgggccgagcttgctcaggaatcaacgagggccttgagaagccgcctctgggcgggatgtagcggctcttgcctataatcctagcacttt

SEQ ID NO: 13460 - DNA, 1521 bp, Homo sapiens
ccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaagttgtgaaatactggtgttgtgggcagcaaaacctccagaaaatgggtgcagctgaggtcctggaggacccccatgtgtgaatccaccaacctcaattaggcctcagccccttccacatgccagttctggggcttcaggaccctttgggggtgaagtcgtccagcctcctacttctaataccaaactggtccagttgtcttctgggcattttagaagcaggtggaggagtttcagtagctttgtccagactctccttggtgcagatgtcagggaagtccttctgagtgtctctccagtggttcttcctgctgtggctgtaacccagatactgccctgcttggcggatcactttggttgtgagcccttagggccctcttctttgtgacacctgcccatcttggcctgg

SEQ ID NO: 13461 - DNA, 1355 bp, Homo sapiens
tgatttttcttttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtg

SEQ ID NO: 13462 - DNA, 1135 bp, Homo sapiens
ctggctaccatgtcatgtcctttccctgggcctggagacagggaggaggtgaccccagcgagcagagtccaaggcatgcagggcagcaggccctaagctcttgctttcctgggagtggcattccaggtggggaatcaaggggagacctcaggagaccccagggctaggatgtgagagtaaggggtgccccaggagtgggggctaccaggggtggtgtgtgtcagagcccctcccattggggtgaccactgccttgccccatgcagattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaagacttgtgcttggccctgagagaccgcctctggccctgggaattgggcagtcttgtgcatataactgtcctttcccaacaggggagaggggagtgccggcctgcgaggtggagccccagcactccacctccaggtgtgtgggagaggctgtgcctgtgagtgggcgtgcagcctcacgcgggtctcccagtcaacaggagccctgctggagaggcaggcgcgcctccactgtgacatgagggatctgcatatggtcatttgctgaggctgccgtaacaaa

SEQ ID NO: 13463 - DNA, 1141 bp, Homo sapiens
atcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaatgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaacagaattttatggctgcagcctcttcgatttgagtttctgtagcatggtttgcctggttcccagagctggagggaggcttgggttgtctcctgttagttctggctcacactgcagcttgctgtaatgctgtgtagacggattgctgggctccctgggactgcctctgactgccccttggtaactaagatttatgggctggtgggaggaacccctagaaccagccttcaaccccaggctgtaatagccatagagccagcaatgactgacggggcaaggcaagcctgagccagcctgaatcttcggagactgtctggcacttacctcaggctgccttgcatcctctactgtttactcaacccttcaccagattgacaacctctagttggaatatgtttt

SEQ ID NO: 13464 - DNA, 1975 bp, Homo sapiens
aagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgagcaccatgttctttgaaaacatgccacctcaaggctgggcgcggtggctcacacct

SEQ ID NO: 13465 - DNA, 1194 bp, Homo sapiens
ctgggactataggcgcacaccacctaattagcgcgcccagctaatttttgtatttttaatagagacggggtttcaccatgttggccaggatggtctcgatctcctgacctcatgatccgcctgcctcggcctcccaaagtgctgggattacaggcatgagccaccgcacctggccaactcagccatatttttattattcacattttgtagacgagtaaactgtgaccccaaaatgttccgtaagctatccaagtccaacttcacacatgtgctaagggccagagctgggatttgtacccaggccacctgacccagctctctgctcttagcctctatgttttgccattgtttttcactctgtggccttgagctgcggagcatagctactgccacgtgaccccagcccactacctattctcttgccactggcctcacaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtctgggcacagccagggccaggtcaggtgacaggctagggtacagcccagggaggagaggctctgaggccacggttggttggcagttgggggacccctaagccagggcatggaaagacccaagccagaagaggccatgagtcccaggaacgggtctgggctgggtccatcagaaatccacaggggcagggcacagaccacaggccatgggctaaagtggtaggtacgtgatgatgggcaggcaggcagcattaggcagctctctcagaagggagttttgtgcctcctaacccagattctgggtattgttatgtgtgtggggtgtgtctgtgtctacccacaggtgatgtttgaggcaccatcagagttaacacaaagaccccaagtagggtgctatatccatgg

SEQ ID NO: 13466 - DNA, 1989 bp, Homo sapiens
ggacccacaactacgatgagttcatctgcacctttatctccatgctggctcaggaaggtgaggggatgcgctgctgtcttaactggaatgccctgctgagggccgtgtccttcagctcccctcccctggcctctcctgaggcttgagcagaccttggggcacagggagggccatgagagcctcagctcctggcctgaggcagccagcacctgctcaagggtctctacctcttcgcaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaatgaaccctcctgtggttgctggcctgagatatggaggctgggccttactagacctcatgggcctagggccctgggaccagaaaggtaagaagtatatgatccttgagtgtccagctgtcttgggccagagatccttggaatcctaggcctgggatttaggacctgagctgaggagggacttcaggtggactgtagacagggtgcactttctggggagagggccatggctttcaccaaatctgtggctttgcagcctggagaggtgctgggactgtgggtcaaagaggcggggctgcctctaatctaatctcgcctggtgtgttctccctgggagggcg

SEQ ID NO: 13467 - DNA, 1132 bp, Homo sapiens
tgcaggaggcgggtgaggtctctaagctgatggctgactggccatcagctatgggcacattcagccagagggccatcttcaaaaagctcaccctattctggactgcgcccctcctctgcatgtatgtcgggggaggtggtgatctagtttggaccctaccatcctctgtctccgggtgtgccgagttggacattattaacacacctaccttttgaacacttgccatgggtcaggcccatgtacaaagcattttacatgcattgccttacttggtccttgattctaagatggaggaactaaggctcagagagaacttaggctccaagttacttatataagtgacacataagctgcagccaggaaatggcagaaccaggtttttaacccaggccttccttaacctctaggccatattgcctcctgatagagcttagttgctaccactccctccccacatcagctgcttgtgccttgattcctggctcagcagcagaaatcacagccatgaaccagttgaaagggttggaaaatgacttgcttccaggaggtagtcagggcacctggaaagaagtacaacagagaagatgctcaggctagaactggccctgctctgcctcccttggaagaaatggccttgcctgcagctccggttgggttttgagttacctagaggcaggaggtaaaaaactaaagaggtgacttgtggtaatcacctttttcattccttactgatggatggagccacatgcttgtctcatgtgcctcccagccctagtgcttgggccatggaggaagctgagaggggccctgctggtcagcaagggtcaggtgcagaggctggtgggcaagggcagcctgactttggccttggggtgggtctgagttgcagagagaaagactgataaaagataattgggaaagataattgcagcttttgctgctgggggaggagactccttgttgctgggctcccttgccacaagggctgttggtttccccttttaggtttacatcatccaggtcactgatggcagccatgagtggacagtaaagcaccgctacagcgacttccatgacctgcatgaaaaggtaactgttaagagctgggagcacgtatctcagggctggggga

SEQ ID NO: 13468 - DNA, 1096 bp, Homo sapiens
gctttgtcctatttcgggtgaaggccagcatcaccagtgggcttccaccttccgtacgtgggtgggttatcatagacagttatctctgtgctcaagagccacttcttaaccggggtgggaggaagcagcttcaggaactgctgagagagcagaactcacgctccagggctcagagcaggaggtagggtgtgcggcaagcgctggcccggacagaagcagagtgggccctggtctcgggcaggatgtttctgactcacatttcctgaggagagaaagctaagctctttgcctaatgtctctgtctccccttccagaaaaatgcctcagctcttccggcctgaaggaatggcctcctcccgggccccatgattctttcctgtgtgggccctcctggccctggcctctgggctgaggcttgctagggactcggggtggctctaaggggcagggatagggctggggagcgccggcctgtggccctgaccagccccttctcgtgcaggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacaggtacccctgtctagctcaggctgcagacaggctgcctggacagacgtcatgggccccagggtggctctctgtgccccagaaccctctctgcctctatgtctctcttttctcacttagctggccagggttttatgtggggcttttcgatggcagagtctccactccagcagtccctcaaccatctggcagacacatctccagtgcctgctttgggctcctggcctgtgggccccacacttggagcatcctctcctgcctgtctcatgccggggtctctcggttggcttggggcccttggtgctcccagccccaccaggggccggttccaggctatagcccaggtggcatctctctgcagggaagatggagaactacgagctgatccactctagtcgcgtcaagtttacctaccccagtgaggaggagattggg

SEQ ID NO: 13469 - DNA, 1217 bp, Homo sapiens
cccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgcatcttctaaaccaagggtcactgggatcccagcagggcttccgtccagggcgtggtcacatgggggagggagggtgccctggagacaggagggtgaggggttgggggaaaggaaggagcagccctccaggagccagatgcttcttggaacatgggaggcatgacagggccatggcctctctggacagtgccatgctgggctgtggctaaaccatgagcgcagggcaaacaagaaactcctcagggcacccctgacacaccagccgctgcccctctgcctgggtgcggggcatgccaccctcttcaggctgtcctgcaggtcttatgtgtcagtcacccctgggcccaaccccacctgtttcacaacccctgttgagagtgggggaggggc

SEQ ID NO: 13470 - DNA, 1115 bp, Homo sapiens
aaacccccccccccccgcccccagcaactggcgctgagcccagttctgccgccccacccaccaggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcaggtgtgggccggggtggctgtgggagggccagggcggtagcctcctgggtgcacacacccaatgcacactttgtgtccccagacctatcaggacgcggagtcgaggcaggtgctggctgcctggatgaaagagcggcaggagctgaggtgagcaggtggggccagggcaggagtcccagccaagccaccaccccaggcccaccccttgagcgcatcgtgtctccctcgccaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcctagaagagcagggttggtggtggagggtgtgaccagggcctgggcccatcccacatctgccacacttcttcacttccatgcttacatcgaagggttcacaaaaggtgtcgctgccaaagacagggttggggacagagaccagggtggggttggtcccttcttgccacggtgagaagtcgtcatcagcatcatcttccgcctgggagcagcagaggggtgagtggcgaggcgcctcaagcgagatcc

SEQ ID NO: 13471 - DNA, 2912 bp, Homo sapiens
ttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggtttggttgttctgttaaagtggtgtcagatgtttcaagcagatttaactcctgcaagccctgatttcatgctgacaaggttgtatgtgactgccaatttaagagaacaaagctccacagatggagatgaaagtcagtgtccagacctctggttcagggctcgggctgcattaacacagagccaaatgtagtcagactgcagactgaagtgccccacgccacgcctcaggctggcagtcaaggaattcctacatgtcctcagcatgggcagaaatgcaggttgaaattaaaattggagaattactgagggcggaaagtgaggaaagcatgtaagcagtatagcccacttcaaatagcttgtctgtggccagaaga

SEQ ID NO: 13472 - DNA, 1202 bp, Homo sapiens
agtatattgtagaatatatgtattctatatttcttcaattctaagactccattaaatgtgtcatattcgtgtaataacttagtgaaatgaaacacattaagaagcattaaggtggggatgaagtatatcagagattatctctagaattacttgattcgaaacgacatacgtacttctttgtgcctttcgatattatccaaaatgtccatatgatcatatattagtaaggtgatgtttttattctctacatcctttgtgtagttatatattcatttaaattaatgatggttgtaattcaaagatagttttgagtagaggctattaggaatgtgaagatcatactattgctgattcctgccttcgcatgttgcaaatggaattaaatgtattaaatgtattattagtatgtgttgtttgaaccctacatctgacttcagcatccctttggtgagtacctttttcctttatttatttatttttttacctaagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtaagtttgttttaaatcaaaggacagtttagtgagatatgactgtttgacttctccttgctcctcagggaagaaaattttaactcagacatcttaagcctttccataataattgttcaatatgtcaataaatgtaagtaagcacccatcatatgaaaaacataggacctattgggcaagtgtcacagttgagtcaaaagaaatacagcttctaggtcgggcgcggtggctcacgcctgtaatcccagcactttgggaggctgaggcgggcagatcacaaggtcaggaaatcgagaccatcctggctaacacagtgaaaccctgtctctactaaaaagatacaaaaaatgagctgggcctggtggcgggcgcctgtagtcccagctactcgggaggctgaggcaggagaatggcgtgaacccaggaggcggagcttgcaagggagccgagatcacgccactgcactccagcctgggtgacagagtgagactgtctcaaaaaaaaaaaaaaaaaaaaagaaagaaata

SEQ ID NO: 13473 - DNA, 1414 bp, Homo sapiens
agtggacagagctaggaaatttgtgtgtttgtttgtatgtttatatttaaagataaattacatcataagttcatagtgatactttcaattgagattaaaggcctcaaggtaattattaatgtcctacgttttaacatccgttatctctttttatcccatgatgaaaatctcagttctccaggataccagaggtgatagaatgtcacatagctactcatttgctttattccttcttattcacagctttctcaaccttacagtagtctcccatcaaaaatataattactgaaaacagttaaaaaaaatttttagtacttttttgtctgcaggttatatttcactatagacatgctaattgctagattttacaaattacttggaatcgtcccttgtggttatgctaccatctgtatacaaatttaggttcatttattttattcatttaacattaaatatctctctttaggtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggtatgttttcaaagccatttttattttgaggatatgtgctatttaatacaaaacagatgaaagaatattgctttgatgtactatttccacttacatacatgatttgtagttggtagcatgctattctgaattctaatcagccagaacttcttaagagtgagtatattctgtgggggagagaaggcacaccactaagtcatctagtttaaggccagtgaggaggaagacaaaattgaaaatctcttgaaaagcataaacttaaaatacagcctttcatagaatgtgttttttaaaaagataaatgt

SEQ ID NO: 13474 - DNA, 1275 bp, Homo sapiens
ggccacccacgcccccagccagcaactcggcgcggacggccccgaggccgtggcgcaggacacgcggcggcgcctcgggcccccgacggcgctgtggccccgagcggaacggcccggaagaggagacgcgtccccgggaacccagtgcccgccctggcccagccccgatccagcctgcgcctcacctcgggttgtagacagagcggcggggatcccagaggggttcgcgggtcggacctggagtaccggcccggcgaagcgcgccgctgtcgcccgcacgtgactggctcggacaagatggcatgagcggagaagcggccggatcccagatgcgcgcgtgccgccgccgcgggcactgcgcccgtttgcctgcccctcgtcggggatcgggcgctccctctgagacctgaaagggcacccaagtgccccctgtctgcgaagtccggcgcgggcccttcggcgcccccgatgtctctaggcttccgcaggaggcgccctgtaaatcttgagtcttcctgcagcgagggggcacaggacagctgcgaattgggacgaacgagcccagagccccgggaaggatcagaacctcgaaggcggcttcaagtcggccccgcagcccgaggtgaccgtgggcggttacgttgcccgagctcgccccctcctcctgagcgcaggtgcccgtgggacatacacccgcccacctgctccggaaagttccctccagaagggagttcccgcgccaccgagacccgggagctcccgatcagactcccaggccgtgaaaggcgttatcggacagggcccagaggcgcccccacagcaagaagaaagtctggggttctcaccgtgtgccaggtgcgagctcaagccacctccctcaaccgctctgagaaatatcccacttcacaaacttgctcaaagtcacgctgctggctggatttgaatccagattttttttagcaccactgaaaaaacaatatgacaaccggagaaagaaaaatctaaaaagaatacagtaatccatattgttacaaagaaatgcaacttttcacgacatgaaacatatatatactgtgtatagttgcaaccacactttttttgttactactttcactaccatttttatttgttcacgattcatttttaaggtgtgcaggtgtccttaactattcactcagccccctaatgtttttggttctttacggttgtttgctaacgtatccttgaattctgcacttgggacaaatacctgggagtggaaaggctcccaggtag

SEQ ID NO: 13475 - DNA, 1099 bp, Homo sapiens
cccagtgggagagatgggctttgactctggggtcaaatgtagataattggactatggacagtggctggctggtcaccaacaatggtgtttgaaacaaacatttagaggccatatttgggcttataaaaatagttctgggccgtgcatggtggctcacacctgcaatcccagcactttgggaggctgaggacagcggatttcttgagctcaggagttgggagaccagcctgggcaacatggtgatacctgtctgtctctttaaaataaaaaaaatcaatgagttatgtgatgggctcatggctacaggtggagaaaggcagtgcatatgcagcctcctccatccttgactaaggctgacagagggctgggcccaccactgctcaccctgaggcctcgtcttctgactcccctcctttcatttctaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcact

SEQ ID NO: 13476 - DNA, 2520 bp, Homo sapiens
tccatgttttcaaaatatcccctcctggtggtccaggagcccagcctggcttgcaggcccctagggacagggagcttcctctctctggagggcactcagatctccagagttcttccaactggacctgaaattctctctgtggtttccagagactgctctgcagggcgtggggctggggaggtcccaggtactagggaaagaggccttgtgttggctggcagattttggagccttgaagggcagctggtttggaactgatgactgtactcagtgctgcttctggatgagtgatttggggcctggagcctcagcaggcatgaggctgctgccctcggaccccagggaggggttgggaggaccggtctctgcagaagaaggtggtgggggacatattcagaagcccagaaaggatggacaatctatatacaaattgtggctttctccacaaaaggggtcctaggctccccgaccaccctctgcctgcccctttgggctgaccctgtcccacctgcccccaggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggtgagtttagccagggtgtttacacctggagctcccttgacttttgcaccaggaggtatgggagggggatgggccaggattccagcccatggatgggggggtaggggtcttatttctgcatatcctttcccccacaccccaggggaagacgggccctcccagatggccctagaagatctggctatgtttcggtcagtccccacatcaactgtcttttacccaagtgatggcgttgctacagagaaggcagtggaactagccgccaatacaaaggtaggttgcatggctgttctttctcctgctggcagccatcacttcccaagggaaacagaagaggaggccagagctggtcacttgctgccccagggggtgtttcctgaccttgcccctggtgttcgtgtagcttgtggaagttagacaagaaaaaacgaaatacacaccccacttactgccacgtggcagacattgtcaactgattgccagtctgtctctgctgagaatcctggcagccctggccggtccagcggttgacacctctccaccctcctgagttgggttctccaagacaggcaaggatgagctgagccctgtggtccaggcccggagctgcatgccacagacccagtgcgcgtggttcctgcccctctgcctggtgcagtctgtgggagtagcccacctgcagccagtctacctggtggaaagttgccttcggtctgaggctgcaaggtggtgggcagttctcagagtgttcaagtggggtgcgggcggcagagggcaagcaaggcccttttccctgctggagtagccaggatgcagtaactaacgctcccatgggaagggatggcctctctagaaagacctcgtctctgaggttgggtgtgccacatcctgtatcctcagtttatctgtttcggtctcagggtatctgcttcatccggaccagccgcccagaaaatgccatcatctataacaacaatgaggacttccaggtcggacaagccaaggtcagtgcctcgcatgccccaggagcccacagagctgcctggaccctccctgctgtgactcccagcagtcagggcacaccctgccccagggccctgagccttactcaccctctgtgtcacccccaggtggtcctgaagagcaaggatgaccaggtgaccgttatcggggctggggtgaccctgcacgaggccttggccgctgccgaactgctgaagaaaggtgaggagaaggggcctccaaagtcatcaactgagcggccactgcatgctaggtcttggggttctttctttcgttctttctgttctttcttgaagagctcacagctagagagaaagcatttcatttcattaaataatgatagcaattatagccatcctttgagcacttgttctgtctggcatgttgctaagtcctggggctgcagtgcccacagtccctaccctatgactctaaagtcgagacccccccagcatggtggccagatcagtggcctggagcctgccagctgggctggaatcactcagccaggcactagttaaggaagtaagttattcactgtcaccatgcctgttttcctatctgtaaaatggagatactagccccttgccctcagagctctcctgagggttacatgcatgtgacttggtattctattattattactgcgagctcacagtgttggctagtggtttgtaggggagacaggcattggcctctcctgcaatagaatcacacagcagatgtcatgttttagcacgaaagagggggcaggtgtggcatcttccagaaagtggcttcagagtgggtaggaattgattagcagagaggagagtgaaggga

SEQ ID NO: 13477 - DNA, 1265 bp, Homo sapiens
gcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaaaaaagagagcgatcattgtgttaagttatgtgggtgttttcatcagctaggagcaaggctgtggaataaggagtcagattctcagcttgctttcactttcaaggacttacagaggagtagtcaccagcctcacagcagaagttcagcccggcccccaccgcttcccccagcctaccccatagaaacgggctttgggctgacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaa

SEQ ID NO: 13478 - DNA, 1202 bp, Homo sapiens
taacactctgaaaatgattaagactattgaattattggtactgcctttttttttccccttggtgatggtggtagttatgttagagaaaagctgttgtatgtatctgttactcattagagatagatgggttttacaaatcagagatgcggagtaaatgtgggaatgacctcagttttgtcagaagaaatgcactaaaagaccctttgtgaagacatgatgtgaaggagtactaaccccactgggtgtgatgcagcggtgatcctgtgtgattgacactgagaccagagctcgtggacttttcttgactctccagctgactaaagcccagcttgtgaaaaatagcacatgagattcaaaatggaaacataggagtgaatgattcccctgttattgatgggagacaacctttgatttttttctcctacccactggatcctcatttaaaaaaaaaaatctttgtttttctccttctccccagaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaagtatcctttttttgggggaagtctttctcattttctcttttaccatctgttttttaaaaggatttgctttctgaagtgacacaaagctgtagcagtctggaatgcgagtaacagaagttgtatataaggggtttcattgtatataccttcctgtctcttcgggttgcagaggggtggctgtacgggtatatttagcccactgtctggatgtgtgtatagtagtagtagtagggggagggagtgacagcctgaaacttcacaggggcagataattaaaatgtgaaaccaacctttggttattggacattagatggttagttttaaattcagtgttgtctttgggcaatagcatgcattgaacctattgcaaacaaggtatacagattagaaaaaaagactgtataagactctgtt

SEQ ID NO: 13479 - DNA, 1201 bp, Homo sapiens
catggggcacatttacacgtccaaagtggtttaccatgagacagccagagcctctattctgcctcatgcatcacctttaaagtcatcagcagagttctgattccccaaccatacacgttggaggttgtttctgaacaaagcaaaaataagcccagctcaactatgaggttggttggagctgtcactacagtgcagaaaatgagctgttcagaattacaaaccaagaaatggtatatggagcttattggtggagaatagggggcggggagctcatgaaaatctgaatttgcagtcacttttctaaaccttcctctccttctgagcatgtatgtcacctttctaggtctctatcttgagacatcgggatttggacggttaattgcccttgataagtttatggtagttatacatgcaaatccctatgcacaggggtgaaatgtggcccgtgaagcctctttttgttttgtaatttttattttaagtaaataaccaagacagcatttcatagtgttactaatatgctgctctattaaactcataacaaatatattattttctgcaacctagagtatcagttcatttaactgacactaattttgagccttagttgctttgcaaaaccttgctttttgctggtttgagacccctgtgttatatgctgagacctcggtgccttctgcgccggaccgcccacccgccccactctgcccctgcccctgccccagccagaagcaagtgtttaggctcttggtctaatgtgctgattcgggagagctctgtctggtctctccgtttagatgatgaggtaaccgtggggaagttctatgccactttcctgatacaggactactttaggaaattcaagaaacggaaagaacaaggactggtgggaaagtaccctgcgaagaacaccacaattgccctacaggtgaattgttgtctcattttgttttctcttttgactaacgattttacaagcttatttgaaatactagagagctgcctattcatggttgagcagtaccacaaggattttgtttaaactgagatactacacactcccccaaatgtggactagccatttctgggccacaaggtaagtgcttccctccccgatgcctaccccatagagccctgcacctgccactacccacgcggcagggctgccaggacggagaggagcgagcgctaccctcgcacc

SEQ ID NO: 13480 - DNA, 1301 bp, Homo sapiens
aaaagttttcttggctattgaaacagaaagatgcctgtagttcataagtcctactgtctttttttgagacggagtctcactctgtcacccaggctggagtgcagtggcgcgatcttggctcactgcaacctctgcctcccgggttcacgccattctcctgcctcagcctcctgagtagctgggactacaggtgcctgccaccacgcctggctaattttttgtatttttagtagaggcggcattccaccgtgttagccaggatggtcttgatctcctgatctcgtgatctgcccgcctcggcctcccaaagtgctggggttacaggcgtgagcctgtatttaatcctgctgtctttaatacagggtgaaagcctggcttactaggtattgactcagcagggatttttctcggccccatattcaagtaaatgattgagtatatgtcttatgtgattaggctgaaatgccttcatcccttctgtaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgttttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaattttt

SEQ ID NO: 13481 - DNA, 1166 bp, Homo sapiens
accaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtgagttcattctatctctaataaatgctccaattgtgcagtttctaacattttgagggtcatggatccccatttgaagaaccctatggacttaagtaaaaagggaagtcattggctcatttaactggaaaggcaaagacgtaagtcttcctttatgtacaactggatctagaggttcaaattagaaaatcagaagttcacattaggaaatttaagttactgtcattgtctcccttcttcct

SEQ ID NO: 13482 - DNA, 1123 bp, Homo sapiens
agagaatggtcgctggagtccaaaagacctggattcaaatgaggccccagggagctggggaattttaccaaaagcatccagttcttctaagctttcgtttcctcatctgcatgaggggctattaaccaactgcatcagtacctcagtgctatcgagctggtttcagataattaatgcaaaacacagagggtggtggcagatagcacgcaacaaatggtacctgttaataattctgaccacaataataatgacaaaaataaatcctacggagacatagcagtctgtgctgccattttgatgtacacagcctatattcatttgaatcccttcatttaaaacgttatggatgagttataccccgtgcacagaaaccaaagttgaaataccaagtccctccactgcctcctcccagcaaactccgtcatccctaacagcagtgtgcaattctgagcacagggctggccccgccccacccccatcccagcccccagccctttgggttctgaagtgttacattttattgccccgtggagctgtaggagtccactctcaaggtaaaatgttgctctccactcatattttttgaattatggtttcaaggtggttgcttctatcaagaaaattaaatgatttaacataatttgttgccactttgatcacaacaataataaataaatcttcatgaggaaaacgggaaacccattccaccccgtttttaaagatgttaagtaataacacagatgtagttatagttttggttttttgtttgtttttttttttttagcagaaacgactctattgggttttcctgtgagcagagtggcttcatggagctgttctgcaggatgcccgctgcccccagaaggagcagctcttctcctccaaccgttgttaattagtctatcaggggcttgccttttatgtgggcaccacgtgcagcgtgttaggggcatctgaagccgtcgtgaatgggtgtctgtttttgtacctgggggcacactgcacacatttggaaagcacatggaacataatggacattaacccagatgtcaaaaatagcctgcgttttactactgttattaaacagtttcccctttaacccctccgtgtttaccaaagaccc

SEQ ID NO: 13483 - DNA, 1107 bp, Homo sapiens
ttgtgttacataatttttatttcttcatttgttagggaaaaaatagccagtactgagaagaaggctagcatagaaagctggctacctggtcagacagttcccagtcaccttgtacctttccagctcagtgcagggcagattttcaaaggaccttcctgagcacagattctgtaaggactgtgaagatcactgagaagcagtgtggagtaagggaacgagcacagaaccaaggaatgagctgacctgagctatgttcttgattctgcaatcatgtaggccagggctgtccagtagaactttctgtggtgatgagttctccatctgcactcaccaggagggtaaccacttgctccacgtggcctctgagtgcttgcaatatggctggtgcaactgaattttaaattttattcaattttaattaattcaaatttaaatagcccagtgtggctaggaggaacctagctatactgtattggacgcataggtaaccgaactagtatagcctgagaaggtttgtatagcagtggtttagaagactgtggctctggagtcaagctgccttggtacaactcctaacatttgctttccataggacattagcaaggtacttggtttttctgtgcttcggtttcttaataggcaaaatagggataatgacagtattttctcattggacttttatgagaattgaaataagaaagtgtacagtgcttaacacagtgcctggcactcattcgtctttcaaatggaccttaggttatggagttaatttcaccatgatacttgattcatgccatactgtcatcattggtccaggcagcatgcaagacacgtgcacatgcacacacatgcatgcacacacgtacacacaaacacaaactgaccatcacaccaagagtcagcagattaattataacattatgtctgtgtggggtttccccctctcctattgtgtgccttgccctgagatacacccatgaccctgggttttgtgtttattattaccaagcttttaataaaatagtcaaactctctgtgcttggaatgctcccttcccccgcttttaagtagatcctccctcctgttctctttgattgccctctcaag

SEQ ID NO: 13484 - DNA, 1167 bp, Homo sapiens
aagttttagctccattataattttatgggaacaccattgtatatagtgtggtgttccttgttgaccaaaacatcattatgtggtgcatgactgtatctatatttaatatataatatgtaaaatattataagtatctttacagtagaatccaacctctttggcgaggcatcccaggcgtttcacagttggatccctgcctacctgttgagccttgtcttccaccatgttcctcacccacactgtgctttctttacatcagaaggatgacaatataaactcacctgggaagtagtttttttctgcctctaaagggaacttgcctcgctctcagatacatcacttagcacagaataggcactcaataaacatttggtgactgtatgacaatagctccccttatagagcatggacaatacagccaggcactgcacctgtctatctttgtgcctttattcttccctcatcccaaatgattttctgttgaaattcatcttcttgtttaaaatatatttaaaaacctccttcacaggtcttctcttacctcctcttcaactctgatcctgtcacaattaatctctttttcttcagggatccaaaggactgtgttcttcttccatttgctcttttttatgacacaacattgtccttgtccctgtcctgtatatggcttcaggtaaggagccgtgactgtacatccttctattgccccaggacctctgaacacaggaaacacccaagtcctgatggaataattcagcggatctttttcccttgtcagcagcttgaggtcctctttgctgtcatgcgatttactctgtgttcactttgaaatgagtctaaagagattaagtctaagaacactctcagctccttgaaggtggaggctgtgtctaattcttcttggtagccctttatctagagtagcccagagaacatgcccaacagatgtctgggaaatgactgatgccttgaaattactgctaggtggtaaaagcttctttgttatatattgttcttggtgtgaaaggcaactgatggccctcaaagcatctgtccagtgaacttaatcagggtatacatggagtactctctgtattagtcatacagctagtgtgggattaatttaggtactaaatattaacttacaaaaagaagggtaaaatggag

SEQ ID NO: 13485 - DNA, 1141 bp, Homo sapiens
cactttatttgggtgacgggattgcagcagcacataagccaccaaaaaaaaaaaatcagggtatttcaatgaatagattattttagtctcacttgcgccaagggtacttattgaaaccaagctccaagagggaaaggcaggaggagtggtcactcccaaaacattcacccccaaaatattcactgttgttcgctatcgacagcatcctcagagaattttaagagtcaagtctatgttgacagcagaaaagtaacagagtgattttacaggccaaagcagatggggtgggttctgaatgtggcctattctggccagaacacaatttcagtttctataattagttgcaggtggagctcttgtgttgttgtttcggagtccattgacatctgtgtgcaaattcccaccacccccagttggcatttggactcaataagtggtttggcctcgcaggaacatagaaaattgtaaatctatttcacagacacacagataaagctgttgtaaaggtcaggttctgaaagctgtggaaagcatttcaaaagtttgggaagtaggtttttaggtagagcgtgggagtgcagccaagagctggggcagtctaacaaccgaattctggcacgtgcaatttcttctgtttctctgtgaagccagtgcttgattgtgccttggaagcaacgtgtagccattttgtttttcagtaggaaagatctggtgagaagtaaagactgaggcagctacttttcatcttacaaacccatggctgggcgtgagctgtctcgtttgtctccatacgttgataaagttaacttggtagttctcaactgtgggcagttttttctccaggggacatttggcagtgtctgaagacatttttgactgttacaacttgggggatggtagctactggcatttagtgagtagagagcaggggtgctgctaaacatgctacagtgcacgggacagcccctgacgttgtctagctcagaatgccagtagatacaaggttgagaaactgagttaactagatgattactataacttcattttgcatatcatgctttgccttcactcagtgctttactttcactttgtgaactgatgatcaaaatgcatgtatttttgtaaaaatgatgatataaaa

SEQ ID NO: 13486 - DNA, 1527 bp, Homo sapiens
ctgttttatatgctgctattttcttttcttttcttttttaatgcctactttatttcctaaaatgctgctatttttataagcgctttggaatcagacatacctgggtttaaattccagcttcatctcttgctctctctctctctctctctctttttttttttttttaagagacagggtcttgctgttgctcaggctggagtgtagtgacgttgatcatagctcactgcagccttgacttcccggctcaaatgatcctccacacctcagctttctgagtagctgggactacgggcacatatcaccacagcctgccgattaaaattatttttttttgtagagacaaggtcttgctattttgccaaggccggtcttgaactcctggcttcaaggagtaattccaaagttctaggattgcacacctggccccagcttcatctctaattggtgcttatagaagtgctaagagctggggcatagggaatgtgataccacgtggctcaaaaattcccagatattatttaactttctgaaggaaattgagataactctaagttgactgaacaagtgattttccaataactggctttgatgttggtctaacgaagtgctctgcctttcttggagtcacctgctgaccctcctaactgtttccctggctaccactcctttggagtttaagcgcctgtagaagcatttgtgatctataggaaaatctgccttttgttttcattctatgtgtagaaaacaatcaccttatccttttgattatctaacagagccaaagctagttttcagacgtagaaatgtgattttgtagttggaaccgaaaggtttgttcttcactctaaaatgatgctcttcggtatcatttctgcttctttctgattttgctggttcatgaagtctttatgaacctgtttgtacaatgcacatttccccccagttttatactggttttctcttcattttaattttttggaaaatggttaaagcagtttaggaatggtgcaagcagggacaaaaagtttgaaagctcttctttaaactgttagctccaaagtgacttatctcatgcttctttcattaagtttatctttgagcacagaccccaattatacatgtatatttatttataaattacaggatgcattacactgccagtgtattatgtgtcttttatgacatccacgaagaattaaatgtggatgagatagagcaaaataatacattgagatacattttagtgacatataaaaccttttccacttttattaaaaacatttcgaaccatttgtccatttcatgagggttagttcagtttagaataggtgatatccataattccacttaaccgtctcaggttgccataagccaggagtgtgtgaatgcttgagggcacttccattatcccttccttgttctggtcttactgtgatcacaggataccttggtatcataggtgaaatgtgactgtgtgacatatgactcagtgaaagctctagtattaatctgtatatttaatacaag

SEQ ID NO: 13487 - DNA, 1149 bp, Homo sapiens
agacatttatcattctaatacttagcatgcacaagatctgctcatttattatactgtagccagtgtaagttgtaagttattatagattatgcatttctacctatattgtagacagtgcatactatggagtatgcattttgtctttgaggtttttgtaagcattattggttactattgtcagcaaaggggttatattaataaaaaggtaggaaaccagatatggcgatttagcattgagctactagatttccccacatgcataaagcaatttaattgcaagatagtagagctgtcatagctttaatcttttgtgagatggcctctgctttggttccaggttctgtgtaaaatgaaagatgtacttttgtttttgatgaaaaaaagcagaaatgatcattcatttagtgctaaccaactagtttagtaatccagtgaagctagatgtcaaaaaattttattttatatttgtcttgtcaaatactgaattaccgtataactttagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagac

SEQ ID NO: 13488 - DNA, 1149 bp, Homo sapiens
aacgtaaggagaccttgtctctacaaaaagacccaaaaaaaccaaaattaccctagcgtggtggcacatgcctgtagtcccagctgccctggaggttgaggtgggagaatcacttgatcctaggaggttgaagctgcagtgagctgtgatcgcaccactgcactctagcctaggtgacagagtgagactgtcacaaacgaaacaaaagatctttagaataaggtgagatattcgtagatatgctcttctattttccatcaagtgtacttttttgtgtatgtgttaagattgctagagttgaaaatacagataaggcaaacatgtttttaaaattttctttcagacctgagaaattagatgttgaaacagttatgagtattgatcatctgaaacagaaaatccctccagcactgttttataaggaaacatacttaggtccaaatgaaggtaaggtaatttaattttattgaaatgcattagaagcagacttgatttggatatttactatgtatttttcttatgtcagttttgaagaatggaatgtattgcagcctttatgaagttgtggaaaagacaagaattggaagtaacatggagagtttactgcaaaaactagacagagaaaaacttgtgagtgaaaagttttttaatgtttctcattctttgttacaaatatgcatattcatgtgtgatcatattagtgtttcagtttatttttgcctctgaaagtaccatgaggtgtctgtctgttgctgctgtttagttaacagtgttttactgtggttctggtattcttttatttgggccatggtattggagcttgtgcaaaccagtctttcccatggaatatcttttttttttttttttttttgagacggagtcttgctgtctcaccaggatggagtacagtggcgtgatcttggctcactgtaatctccgccttcctgggttcaagcaattctcctgcctcagcctcctgagtagctgggattacatgtgcacaccaccacagccagctgatttttgtatttttagtagagacggggtttcaccgtgttgtccaggatggtctcaatctcctgacctcgtgatctgcccgcctcagcctcccaaagtgctggaattagaggcgtgagccaccgtgcccag

SEQ ID NO: 13489 - DNA, 1209 bp, Homo sapiens
aggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaaggtggtgcctccccttcttctcaaccccctctctctctcccctccatcttttcattagaatctttctatctcctcttcccacacccatccgagatacgtaaacacgcatgcagcgccggccgcctctcccctcaccgccacggccgcccagctgccgcgtttggtgcgagagaaagcggtggaaccacgctcccctgctgcccctccccgcggaagttggaagtagctcaggtttgaagcttgtccgtaaggctgcagctcccagagaggaaagatggtgctcggcgcccctccctcccagcccctgaaagcagagaagccgttgtgtcctcctaaggatgcttctgagaagtctcgctatggaaatagcccgtggccatggattctggggctttctccaaggccattgccaatgttctgaggaccatgagtgcttctccccgtggaaattcttcagttctgtgtgtctacttgaaatgtgcttgatgtcagcgtcctcccttatttagaaatctctattagtagatgtgatccatgcacactgctgttttccatcacacttcatttccatgtagatttttcccccttgtttttgaagcgttagattaaataggtttttctctctttaaattcgaacttagtattgtttttcttatatttgaaaagaatggaaaggtaggttcttggagcagtaatttcccaatggaaaaaaactaatgagaagttaccttattctcaagagtcaccaacttggtcttctagatggtagaacttcaggttaaaaaaaagtccagtcttagtttttggaacccatatggaaacagttacattaattacttgtacttttaaaaaatcttaatgccatatt

SEQ ID NO: 13490 - DNA, 3124 bp, Homo sapiens
gacgtgattctgaatgcactggacatgtcttgattgcgtctttacatttcacagtgtcttaaaagaaaggcaagccagttgttaatttcagaatcagatttatgctctctcaatttaaaaaatgctgggaacaatttcatttttttttttttgagatggagtcttgctctgttgcccaggctggagtgcagtggcgtgatctcggctcactgcaagctccacctcccgggttcacgccattctcctgcctcagcctcctgagtagctgggactacaggcgcccaccaccacgcctggctaatttttttgtatttttagtagagacggggtttcactgtgttagccaggatgatctcgatctcctgacctggtgatccgcttgcctcggcctcccaaagtgctgggattacaggcgtgagccactgcgcccggcctaacaatttcatttaaactccacaacctaaagggctttgtttatagttttagctcttggcataatttttttcaggtggtgtgcaattctgagcataggccaagacatgattaggaaagcaggcagttgtagagagtaaggcaaggaacctcctagcgtccattagagccaggtatttgcattatcttccgttttaagtggtctgtgaattgactgtgttttggaggtgtgaaacagtatacagagaaaagcttttcctgatactgagatatcagttaggagtccaaatggggtgttgggtcatccttgccatatcacctcctttccaggctcagagtgaaaatagacaaaaggaaatctgactgcaagccagtggctttgattccagtttcagagtttagggactaggagagagtttagattatctagcatattctccccctggtgtcagacagggctgtgcctgaattattccagacatatggctgtagatggtattctttattttataagaaggagattctgtaacctaccctgctgatcagatagttctttgtatgtcttagagaaattcaagccagcttccttttgttcggcttgtagtggagaaagaacagctggtcaccttccatgtattcaaaaaccacagtgaagtcatccccctggtgtttttatttcagtgataaataattccacccacttaaaccattcttcatggctcttgttttccaggggcctaataattttcactgctgtaatgtttctcagcttcacacttagtttagttgcccaaacaatgttggtgccttactcacattggtgccttgtgaagacgaggctcaggatggggattatggggaaattcttgcacacccagctcctcttaccacttaaaaatataatggcactttcacaaaatgatatgtcacctatattcattgagaattatttgactgccacatttttcccctgatgatagtcatctatcataacttgtgtttgttttcctcctgagatcaaacacttggtgcttattcctgatgtatactctgagaccagctcttaccttctgagtggcagctacccctccctcccaattttagatcctatttttacacatctctatagatatcacctttatttcatgactcacaatattaaatggtacagacttcagtttaaccactggtgtggtaacagcagtagttgctaagtaccaccttcccattgctgtttgagggctaatttgcaaagacatttgaatctcccagtgaagatgtctggggaattttggccagttgtcttccctcttgcccttttgttctttaaaattcagcttggaccatagacacctccaggatcttgtttatgttctgctctcaattgaccaagcactgcgttttgcacaatcagaagtctcacaaaagcaaacagttatgactgcatatctgatgtttatatcctataaaatttcaggaagattcagagtcaatcttctatttgtacatgatgtagacaaaattagctgctccaattgttagacaaaaaattgccattggattacactaatgtgctcatctgttgttttaaaagtttggtatcaggcggggcacggtggctcacgcctgtaatcccagcattttgggaggccaaggtgggcggatcacctgaggtccagagttcaagaccagcctgaccaacatggtgaaaccctgtctctactaaaaatacaaaattaatcaggcgtggttgtgtgtgcctgtaatcccagctactcgagaggctgaggcaggagaatcgcttgaatccgggaggcagaggttgcagtgagctgagatcacgccattgcactctagcctgggcaacaagagcgaaactccgtctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgttttgttttaaggttgtagtggctcatttttcagcacatctttcttgtttcctgactgtctggggttcccagcccagttttcagagggctctgcctcaggacgaggaggccaggggtggccagtcttccttgccctttagagaacaggaccctgctgccctagaccttcagctcggctccacaggcaatcagtcgcccattacccgtgtggcatcaggaggcttccctgttgcaacagggttacttatgtcagaaagaaatttgacttctcagaacaaatggactttctttttagaaatttgaaaaaagccactgagatttgggggctgcacgcaaattttttttgtcactcagaaaaagagatgcctgctcagtc

SEQ ID NO: 13491 - DNA, 1557 bp, Homo sapiens
gcttgtaaaccctgtaagtaatagtgttcttatctatcaagtctcaaagtatcgccactatgatggtgttagggtagcctctggttgctcactctgggtcctaccttcttccagtctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggtgagctgctgggtgtatataaaggaacactgcgtgtttcaaagcgacccccaggccactggaatttgggttgctcaatgtgagcattaggctttgttggctctcagtggttggtagatacttgagaatgtaatcattgggcatgtctcagggccatcttgccactgtccttcattccctagttatctgtaacccagctgtcctggtggtgatatagcctggtaacagtattgccaaggaataaacaagaagtatttctcatttgttcatatatatgtatgaacaaatatatatatatatatatttttttttttttttttgagatggagtcttgctctgttgcccaggctggagtgcagtggtgtgatcttggctcgctgcagcctccgcctcctgggttcaaacgattctcctgcctcagcctctggagtagctaggattataggcgcatgccaccacacccaactaatttttgtatttttagtagagacggggttcaccatgttgcccaggctggtcttagactcctgacctcaagtgatctacccaccttggcctcccaaagtgctgggattacaggcctgagccaccacacctggcctgtccttttatattttcagcattcatcatgtgctctcttgtgtggcaggccctgagctttatgctccttgaatccataccactctatgaaacagaggctgctgtcatccccattttacagatgagaaagctgaggctcagggatgtcacctggcttgctcaaggccgcacagctagtaagtggaaaaatcagatctaggagccaagccactgataactcagtggctactgattttacaaataggccaaggttaaatagaaactaagtaacccagcctttaaactgggagtggtcagaagagtggaaaccgtttcatggatgttcacaggactgtctgattgcctctgtggataccaagaaagtttttggtcgtggtggcaaagcccagtacctccttagacatgctcctgtgtatgtcaggttctgtcatagtttgctctccttgctggctctcatctctatcaaggtctttgacctcctgctcatgttaaaattatggcaaataaaatatgtataaacacagactggtaatttctttcctcacccttttattaagtaaaggttgttcaaaccagtttctttgtcttcaaatcaaatattcctgctgagggtgccaccagctaagcatagactatggcaagggtcctgggctgtcctgggccttttatcaaagggaagttcagataacat

SEQ ID NO: 13492 - DNA, 1198 bp, Homo sapiens
cactaatcttctttctgtatggatttgcctacttttgatatttcatataaatggactcataattttagacttctttatgtctgttttcacttagcataatgtgttcaaggttcattcatgttgtaatatgcctcagtacttcattccttttttggctaaataaaatttcattgttatggatataccaagttttgtttatctggtcatctctttatatatctgtgtatctgtttatctagtcattgtttatttgtgttgtttctaccttttaactagttcaaataatgttattatgagcattcatatacaagattgttttttttgttttgaacaacagttttcagttctcttgagtaggtacccagaaatgggattgctggatcattgcatggtaattttatgtttatttaaaagttaaataattttagaaaaccaccaaactgttttctacagtgcctgcaccattttacattcctaccagcaatgtaggagggttccagtttttccacatcctcgccaacaattattttagtttgtgtgtatttaaaatttttttaaaaattatggccatctgagtgagtgtgaaatggtatctcattgtggttttgatttgcattttcttaatgtctaatgatattgagcaccttttcatgtgcttattggccatttgtttatctttgaagaaattatatagatcctttgcccgtttttaaattggttgtctttttattagttgtaaaagttctctttctagatacaagttacttatcagatacataattggcaaatattttctcccattctgagttgttttttttttttttcactttcttgatggtgcgctttcatgcatagaagttttaaattttgatgatgtccattatatattttctcttgttccttgtgcttttagtgtcatatgcaagaaagtgttaccaaatccaaggtcattctgtgttttctaagagtttagtaaatggaattttttgactatatagtattttgtactatatcacataatttttagtgttttcctatataaaatatatcagaaccatttttactagattatgtttaatttacataacactggttaaatgtctgtgtatagttatttggcctttttggtctttctttttctagcttagctcttgtcatgcagtgctttcaactcaacttgctgatgccatgatgttcc

SEQ ID NO: 13493 - DNA, 1271 bp, Homo sapiens
cttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttc

SEQ ID NO: 13494 - DNA, 1031 bp, Homo sapiens
ttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaag

SEQ ID NO: 13495 - DNA, 1593 bp, Homo sapiens
agtgatcctcccatctccgcctcccaaagtgctgggatttataggtgtgagccaccacgcccagccagaagtagctttaaatatgggagagttttgtgagatgcaagaggtgtgaaaagactcttaagtttgattaagaaagtttaaacactggtgttatatattaactttgttaatcaagtattttcttgtcttctctttacagtggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaattgtgtgtgttctttttgagttttgaaggtatttgaaatgtattttcttatgtagccaactttgcttgcatattttatgtactgtgaacagtaacacagatcccactggtaggttactaattgtataaagtggagatctagattgttttcatgtgtataacagcatggggaacactattaaaaacatagttttctaaagtcagatcaagggtaaaaggagggcctggcatggtggctcacgcctgtaatcctagcactttaggaggttgaggcaggagggtcacttgagaataggagtttgagatcagctttggcaatgtagtaagaccctgtttcccctgtctctacttaaaaaactaaaaacaaaacaacaacaacaaaaaaatcaggtggggggtggggaggggcggcatgtggagtggggtagggagagtaaaaggctgtaataaaat

SEQ ID NO: 13496 - DNA, 1230 bp, Homo sapiens
agcttttgttgttgttgtttttgtttctgttttgtttaaacaatactaccttgccaaaaatagaagaatgtgatttggtagagtagggttgtttggtttgtgtttgaataagagtatcctacagaagccactttttttttttttgagatggagttttgctcttgttgcccaggctggagtgcaatggcgcaatctcggctgactgcaacctccacctcccgggtgcaagtgattgtcctgcctcagcctcctgagtagctgggattacaggtatgtgccaccacgcctggctaattttgtatttttagtagagatggggtttctccatgttggtcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttact

SEQ ID NO: 13497 - DNA, 2454 bp, Homo sapiens
aacaaagttgaaaacttcccaggactttcttgggacgtgttagacttccaaattggtgttcctgctattatgactcttcttatacctgcactccctcacttttttttttcttttcaaactttatatttatgatgcagaaataagatttttccaatattctgttaagtattcaggactctctggaaccaaggggttaataggtatgaaaagagaggggagaatgtgatattgactcttggtttctttccacacagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccctacgcatgtttgagttgaatatcattgaagttcttaatgctgactctactattgggttgttaatagtcttctcttgacatgactctttatgcaacataacatacatttggtattcttcagggtttaaaagaaaacactgagctgtttcctccaagttttattaaccttttatttaacttactgctttatttttttctcttttaatatggttattgttaaaatgagagtcacttgctagactggtctctttaaatgtaaggtctagtatcaatatttacttcattcaagtggaataaatggctttttgtagttacttccagttttcctca

SEQ ID NO: 13498 - DNA, 1156 bp, Homo sapiens
gtgtggcggctcacacctgtaatctcagcacttcaggtggccgagacgggacaattgcttgaggccaggagtttgagaccagcctggccaacatggcaaaaccccatccctacaagaaatataaaaattagctgggcttggtagtacacgcctgtaatcccagctactacttgggaggctgaggcatgtgaattgcttgaacccaagagacataggttgcagtgagccgagaccgcgccactgcactccagcctgggcaatggagtgagactctgtctcaggaaaaagaaaaataaatgaagcataagcattgaaaatgaggggtcagagtgtctttacttacattatactaatgtgaaattccctatgtgagaggtgtagtaattgagttggggtggctacgtggaatagtttataaagggaatttgcatgaattttggcaataagcagaccagcataaataaatggtgcacatttcactttcttttccactctttccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggtgagctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccccatctttacaagaaatacaaaacttagctgagtgtgatggtgcgtgcctgtaatcctagctatgtggggtgggggctgtgatgggacgatgtctgagatgggagcc

SEQ ID NO: 13499 - DNA, 1204 bp, Homo sapiens
gggatataaattcttagaacctttgcctagatatgctgccagacacttctctgaggaacagtttgttattttttctgtaacttagttcctcttcagcatttccactgcagttggaaatgtcgttcttggtgcctggccctgttaacatcttgagagcagggactgtgtcttgcccacctttatgtgtacctggcacttaagaaaatgcccaatatgtttgctattgaaagtcaaccttcattgccatacctttaaatgctggcaaacccaggctaacctttagtcaacactcagagcttacagatgctccttatttagtaagtaattgatgacgtaaccctttgagcaacacctgatcaggggatctttgggatatccctctgaatggcagcagttggaggcctaacatttacaggcacagacaacatggatgggtatgatttgttcttgggcctccaggatgtgtgtccatacttccattctcttcccctgaactcttctccaggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtaaggaaaattccttctcccgagcatgctgttattggtggaaactgtaacagctgccgtttgttgaaccctgactaggatatcctcttcaccttttttttcctttggaaaaaaatttgttaagcagtcatgaccttgtagagtcccagagtaatctctagaaactcagagaccctttggctgtaagggtttttagggaatcttactggccaccaaggtgtctatcataataagggacttgggcaatatcctggcctaagcccaggcattttgaaagataactcctcagaaaaacacacctttatgaaaatgtttctacataaaacatgacaggtttttaaccggccagctcttccttcttccatcttcatggccattctccatggctggaggagagagcttcctgatgctgttttgtttggagacttgactctgaaatcccaggactcaa

SEQ ID NO: 13500 - DNA, 1132 bp, Homo sapiens
ctctgtgtttaaagagaaagacagacagctgtctgcagccctcctgctgcctctcaaagccgccacttgcacattcagtttctgttcagggggaaagccacccactgctactctctgccacttaaaatgcaccttcttttccaggccacaagcaactaaacctttccagatggagcctcttgggactcatagacattgctgtctctcacttttccactttcccgtgggtgctgctgggaattttacaaacagactcccgagtgattgctaacagttggtcagcatgacctctccagtccctcaggttctaccctgggtctggagccacttagacaaagcccataccacaatgggcagccgcattcccaaatcccggcctcactggcttgtagaattcccagcagctctaacccctgtagcttcaccagctcccgctgttgtctgctttacccagtgaccactgccttctgtttttaggtgaccgaagaggcctatgtcccagtgagtgacatgaacggcctgggatttaagccttttgacctggtcattccgtttgctgtcaggaaaggagaaatcactggtaagcacttgccataaaggccgtctcattctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctatgtatccagctggtttcatggtgttctcaagtcctttctgagcttgattttgccagttgtagaaaactctttaagagttgtctgctatattttgtggaagccaaatggaactggaaaaaaaaaaa

SEQ ID NO: 13501 - DNA, 1150 bp, Homo sapiens
tttttgagacagagtctcactctatcacccaggctggagttttagtggcatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactcagtgttcaaggctcatttttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggtgagctaggctacccttcctggctggagccaggacatcttgggtgggagatggggactcttgcagtcctttcttgggaatgggtagcacaatggagtgtgatgtgataaacctgctgggtcacacgcacgataaatgcccaagcgtatttgtgcattgtgatatcgacactctggattgttgggtgtcaggaaagaggacatatttctatttctgagagtgtgtctctctcctgcttcctctccgccatccccttacaagccccaatctgtgttctggtccaggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgt

SEQ ID NO: 13502 - DNA, 1203 bp, Homo sapiens
ccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttgccttggtgttcttggatgatgtcgcttctgaataaattgtttaatcctaggagttcaacaccctcagcctgggtaacagcaagacccagcctctacaaaaaattaaaaaattagccagcatggtgatgcatgcctgcagtcccagctactcaggaggcggaggcaggaggattgcttgagcctgagaggccaaggttgcagtgagctgtgtttgcaaccctgcactctagcctgggcaacagagcaagacagtgtaacacacacacacacacacacacacacacacacacacacacaggcacatcgttggagccccagatcagctctcccaaccccttaagggacacaaaactagcaacttgttttgacaatgaacctgggctccttttgtgggggtggggtggggctggtaaacaagctgtcacctgtcaccctgctgtgcttattgttgctgctgcctctgtttctcttttttttttttttttaattttccttttttgagacagagtctcactc

SEQ ID NO: 13503 - DNA, 1226 bp, Homo sapiens
caagctatagtaaacatcatgtacctgaatacgtacaggataaagagattgaaagctaggagtggccaaacgacttcaactttaaacttgtaagtttggcatttctcttcaggcagatatttttaaaagcaaatccagaaagcggttccccataattagcattccttacattttctcttcctggtcagccacacctctgtgccaaggtggtagtgcccagctggcatttgcactctctcagttgagccttccttctcctaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatgactaatttttttttttttgagacaatgtttggctctgttccccaagctggagtgtgatggcacaatcttggctcactgcagcctccacctcccaggttcaagtgattctcctgcctcagcctcagtaggaaattagccaccacatccggctaattttggtgtttttagtagaggtggggtttcaccatgttggccaggctggtcttgaacacctgacctcaggtgatccacctgccttggccctcccaaactgctgggattacaggcatgagccaccacacctggccatgactattgtatttttatattgaaagaattggctgggctgggcgtggtggctcatgcctgtaatcccagtactttgggaggccaaggcgggcagaacatgatgtcaggagatcaagaccatcctggct

SEQ ID NO: 13504 - DNA, 1194 bp, Homo sapiens
tgttttgcattttgtacagctctggcccatgaagaagtttagaactgtgacaattagttttggatcctggcaagtttcctaatcctaataagcataactcttaagtcttttggccctctccctttcttccttcccctcctgccagttctccacactcagtttttcttgtcctttgtcaagaagttggtccttctggtcactggtgtttcttctccacctggaaccacatgtttagagtctcaccacttccacagtgctcttccttcaggcctaaaccttctacctgcataaagaaaatcccccaggagagatggtgattcctgcttcgttgcccttgtttggggattccgggccaagccaacagctaatgtgtctgtggttccccttccccacaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaatagcttttaaactgcttcttttcattcaccccactttcttttccagaatattcctatatgatactttccttctcttcgactcttagaaaaagaaacattgtgaactggtcagactttatgatcacattttattggcactggacccactatttccatttcattattgttcatccagagtttgctggagatcacaacattgttcatcacttaagctgcttagcactgtatttttct

SEQ ID NO: 13505 - DNA, 1119 bp, Homo sapiens
ttttcctcttcctttttctttctccccttttctgccattttgtttcttctttctcttccttttctccctcatccttttccctctttctcttgtttttcttctttgtcctctcttcccttccatctatctttattcttgccctttgccttttacttcttttattcttcttcttcctaatttttcttttccttcttcctttccttctcatttcttatcactctccagctgcttctcttccttctctcacttctactcctgtgggagtaaacttactcaagaagagaaagtgggtgcctgagggccacaggaaatggtaaatgctagttctatcatcctggctgctaactacagacatctttagacacccaaggcacctgcaggattattcagggtccaagcctgcctcctcccgcacctgttcagcaagaactcaaccttaggctcttcagcccttagtcccttcattgtcactactccatccacatcctaacctcagaaatgagctcgcaaaatgttctgtactggtaaatgtttaacacttgtctctggggtggtaatggagtattgagggtcctgatgcttacttagtacttgctagtttctgtggtgtaaatattcccaccatggctgctttcaagctaccaatctgacatcactgaatgtggagctgggaggagatgctcaccacggagcctcacaaaccagtcaagcatactgctaaggagtagtactacatatagccatggtccatatgtagtactactgccttccaccattatgtagtactaccaccatatgtagtactactgacttccacaattaatgcagataattgagggttagccgttagtaaataaattactctcacttcaaacatcagatgtctgttaactccttaacagactcattttttgacagccattgagataattaaaggcagcagcatattataattaccacaacactaccttttagtttgcttaaataaaatttaactgcaagtactgtcagaaaaattcaggcttttcaactgttaccctctttttacttgtgagtctgagcttgatatccctatgaattgacaacactatttggattatagatatcataaagtttcag

SEQ ID NO: 13506 - DNA, 1214 bp, Homo sapiens
tcttttaaacaaggtggttgtaccagataggccaactagaatggtccttttacagaacgaacaggctgttgttttgccttttctcagcctgtgagagatctgatttatgtttgattctttaacttacaatgaggccgattatctagaaaaacatctgtattgaaatagctgagaaccggattcagtcccttcaccctcagctttccctctacatgcttggtcgtcttgtgaacaaatagcctttctcctgagcaagactcacatgtgatattgcagtttttaaatcaaatcagaaagaatatgcttcaaaaataatttcttaaggatttattcactgtttgcttagtgcaggggttatatttagtcgcattttaagctctccaattttctctgaaatgtacacgggagggaaatgagagaagcaattgaaaaacaatagaaaaagcacttagaataaatagagaaggtttggtaaaaccttccaatgtgtgggaacgatttcaagactttctacagatctttaaacattccacctgtttcatttgggtgttaaatggaatgtatgcactgctttcaaagctatctagaatcctagaagttttgcctccgaggtaataaatgtacaaaatgcatcgttgtgcctcttggctatcaacacgccctgcttcagacctttttgagataagtctttatctcagctttttacttcctgcttcataattgcccagctaagctaatgaagcccatttggtgttgtgagcattcaaagcgttcatttgcatgaaagctaccaccccttaattatgtaaaacagatattaaaaaataattccctgcttctgatcatgatcaagactctagggatgaatcctaaaattcaagtccgttcagagttgtccttttatgctcataatcatttgctaaacttaaaacgcttgggtgcttccttttgcagtgttgtctttttttttctctccctctctccttctctctctctcttcttctctctctctctctcccccaccccttgtgttcccttcccttccctccctcacctgcaaatggtggcacagtgccagcagcacccagctaccactctgtttgctgggtgacatgaatcctgcaagttaggaatcaaggtgtaggggaaaatgatgtggctttggcatcacttccctttcacaggtgtcttattacattttgacaggtgtctga

SEQ ID NO: 13507 - DNA, 1103 bp, Homo sapiens
tcttcgacattgctgtcaatagcgagcccttgggctgcgtctccttcgagctgtttgcagacaagcttccaaagacagcagaaaattttcatgctctgagcactggagaaaaaggatttgattatgagggttactgctttcacagaattattccagggtttgtatgtcagggtggtgacttcacatgccataatggcactggtagcaagtccatctacagggagaaatttgatgacgagaacttcatcctgaagcatacaggtcctggcatcctgtccatggcaaatgctggacccaacgcaaatggttcccagtttttcatgtgccctgccaagaccaagtggttggatggcaagcaagtggtctttggcagggtgaaagaaggcatggatattgtggaggccatggagcgctttgtgttcaggaatggcaagactagcaagaaggtcactattgctgactgtggacagctctaataagtttgacttgtgttttatcttaaccaccagaccatttcttctgttgctcaggggagcacccctccaccccatttgctcgcagtatcctagaatctttgtgctttcactgcagttccctttgggttccatgttttccttgttcccttccatgcctagctggattgcagagttaagtttatgattatgaaataaaaactaaataacaaccacaacaacaacaaaagaattcagtaacagagaagtggctggttgttaataattaaaccaagttaacaaaaagtgagatttaagtgattgtaactttaattataatactgaatgcaaatgtaaaactatgcttttgaaagagaaaatatgtcacacaaaataatgctttaataagcattaaatatttaataccttaatatttaacactaagcaataagaaacccaggatcatatttacaaggtccagaaataaatttgtgacaaattctcatttttctaggggtagactcaaatattctaaatatttgaaagttttaaaatgtattcgttcaacaaatattaatattctttttgatataccaggtgccactattagaaacaaaagtaggatgcatgacttccaaaccaatggagaga

SEQ ID NO: 13508 - DNA, 1139 bp, Homo sapiens
tcagtcactttggatgataatttttttttttgctattatttttaagtgacagattgcagtacgtattttaggacctgccacccattttgatttgaaagattatgttgtcggaatttcagacactgcaggtaaagatctaattttactaattaacaaggatttacaaatcttgtaaattactttcctcttgcaatggaaagtgcttttctctgatttattatacaaataattgcaaatccttataactgaacaaggtaaaacttttcgtgtcttttggaatctgttttctggttttgtgccttcagtaatagtcttaccttagtagacaagatgtataaattgtgtaaattactaagcaaaggtgaagggaaatatattttggttatttccagttagtaactgcctcttaatgaatcacattaagtgccatagtcacttctttttttcccaaattgtctttaagaaggtacatttgcaccctaagtacaaaaaagggacagtattatttttctgcttttaataaaagtaataatgtcatatttttcctgttctagaatttcaggcatcaccccctggagctgatggagagactggtattccactgtgtatcttaatatcagggaaatatctcacaggcacatcaagctgatatcacagggtttccttgattgtaaacaatagaatggattatgactgacatgagccaacacttggatttggaagggtatgatagatttttttgctcagggtctaagaatcgtaagataccaaaccttggaaggggcaggaatcaggacagtgggagctaatggcaagttggtggtggaatacattggccctaccatgttttgtttttagacatggcattcccaagactcagatccctccttgggcgaggttctgatctgcatgactagggaggacagaacaactgcatggttaaggcagaggaaagttgggggactagaacacagagaaatcggggggaaggaccttgaggttaattacaactaggccttgctttctttaaggttatccagtgcagggctttgatcatagagtggattttcaaacattggagcaggaagaggctcccgactctcaccaaagccctggggaatgaatgacttgttcaggag

SEQ ID NO: 13509 - DNA, 1227 bp, Homo sapiens
ctaatttcccctgcgtttattcccattagaccatattcttttatcctgtaattgtatttctccgtgactcttcattcttcatcaaacataggcataaaaatacataaggttacctatttcttagagtcttcatttccaaatgaagcttcccgtgtcacataaaacttacattaaataaatatctatgcttttctcttgttaatctgccttttgttataggggcctcaaccatgaacttaggttgggaaggaaagagatttctttttccctacaatttgatataaagtctccatggcacataagagatagtcagttaatgttgcttatcatcatcatcatttttttctggaaagggccacatagaacatgttttaggctttgcaggtcataccttgtctgtcaaaactattcaacactgcccttgtagcaggcaagcagacatagataatgcataagtgaatgggtgtggctttgttccaataaaactttatttacataaacaggcaggctggatttggcctgaagatagtatgtgaaccactgtagctgtgtgtgtcaatacagccttacttacaaaaccaggcaggatagatttggcccatgggacatagttggctaatccttacgtagcagtggttctgaaaccttttaatttcagatctcctttatactcttaagaattattgaataggacctgaaagaggttttgtttatgtggatcatatctgtggatatttactgttctaaaaattttaactgacaaattaaaaaaacttaattcattttaaataactaatacaaccatagcatgttaacataaataacacatttttataaaagaatatatgtggcacatatacaccatggaatactatgcagccataaaaaatgatgagttcatgtcctttgtagggacatggatgaaactggaaaccatcattctcagcaaactatcgcaaggacaaaaaaccaaacactgcatgctctcactcataggtgggaaattgaacaatgagaacacatggacacaggaaggggaacatcacacaccagggactgctgtggggtggggggagcggggagggatagcattaggagatacacctaatgttaaatcacgagttaatgggtgcagcacagcaacatggcacatgtatacatatgtaacaaacctgcatgttgtgcacatgtaccctaaaacttaaagtgtaataataacaaaattaa

SEQ ID NO: 13510 - DNA, 1655 bp, Homo sapiens
aatatcagttatgtaagacacagagaagcccagcagtatatgctgtacattgctgcattctcctcctcaaagaggtcatctctaatgacattttaaccaacacacacacacacacagacacccatggcctgacaaacctgagcatcaggaatatcacatttaagtagtctgaatagtgtaataatgaaatgggtttagaaaggaagaatacagtgactcccatcatacaggaaaatctgagtctctcgattttgacaaggtaagagtggagatttcaaaaccaatagtattaactagccaatgatgcttacgtctcactcagcaggaggaatcttaagtcaagttggttgctaggcagagagctgaatgagtgacaggtattttcatcagggagtttccataaactctgtctcttctcagaacttctactgagcctacctcatttccagcccgaagcaaaaaaagataaaaatattaccagacccgctcttttccggttagcgcggcgtgagaagccatgagcagcagtctctcgcaacaccctgtacgaggcggtgcgggaagtcctgcaccggaaccagcgcaagcgccgcaagttcctggagacggtggagttgcagatcagcttgaagaactatgacccccagaaggacaagtgcttctcgggcaccgtcagacttaagtccactccccgccctaagttgtgtgtgtgtgtcctgggggaccagcagcactgtgacgaggctaaggccgtggatatcccccacatggacatcgaggcgctgaaaaaactcaaaaagaataaaaaactggtcaagaagctggccaagaagtatgatgcgtttttggcctcagagtctctgatcaagcagattccacgaatcctcggcccaggtctaaataaggcaggaaagttcccttccctgctcacacacaacgaaaacatggtggccaaagtgggtgaggtgaagtccacaatcaagttccaaatgaagaaggtgttatgtctggctgtagctgttggtcacgtgaagatgacagccgatgagcttgtgtataacattcacctggctgtcaacttcttggtgtcattgctcaagaaaaactggcagaatgtccgggccttatatatcgagagcaccatgggcaagccccagcgcctatattaaggcacatttgaataaattctattaccagttcaaaaaaaaaaaaaaaaaaaattccagacccaaaggcccaatttcttcctataaaaatgtcctaagagtcacctactactgaagatatcaacgcaactgtttcctacgtgcctcatttaatttcccagagccaccggacatagtttataagaataaatgtttttattccagaataaaaaagcagatgtgtatcccatctgccttaactgtgtcttcgggaggattctgtgtaatccttactctcagtgtttcacagaaatattgacttccggggaaaaaaagacttgcaagctgtgttaactcttctgtgttaatttgcagtctaaacatttttcatacaaagagcccggctcctctgaataccacatgaaacagcattcgtgacatagatgttttttcttaagttttactctcagagagatgaaagggtcactgagtctatattgaatatgaata

SEQ ID NO: 13511 - DNA, 1104 bp, Homo sapiens
tccttttcatttttatttttacttttacccttttgagctaatgaagggagagagcattgttctaactatgttgaatgttacattgcaaataattttcttacattttaaggggacaaaaatgaagaccgaaaactagggatagacttttctggattaggcttcccaaaactcccaaaatatgagaggtggattgttatttctagaagagatttttgatgctcaaaaatatatggaaaatgtattaaagctaattaaggaatgcttgagtaagatagaccactttggaaattactttggcactgaataattcaaactccttctatgaaagagcttggaggcatggagtattagtcttaataataaatctatgtattatgcaatgttgttgcatatagaactgaaagtattcttttcataatgatgctcgggtttaaatcctgaatttctcccagcaaatcctgttaaatttatgccagtgtaaaatttataggtctgatctttaattataccttatctattggctttttgcatccttttgtctattgataaatctgctgcccctgcagggagaatatcctatctgttttgttttgcagtgaacagatagtgattctgaagttttccatcacacccagtaccttgtgattagaattatctaattagaggctttttgtcaccatttctgataaatgaaggaaattggcagatgaaagccaaaattacatatatatagcatcttgccaagaaacccaaagaaaatttatcattttgtactctgtggctctgacatcagtcaggaggaggcacaaagtggcttgctatttacagttcatcagtttagaataataatgctgttagtcaggaaattggaagttatatcccattagcatgtccaattgcaaatggcagtgaagagatgaaagcccttaaacttttcccattatgtagttaagaatgaccataagtggtgccatctttgtgatggagtgattgttgatgtctttaactttggtagagttcagaagtctccattttgtatttctggaatgcattgtgtctgaatttgggtattgcctccagtagtagaaggactaatggttcaaa

SEQ ID NO: 13512 - DNA, 1172 bp, Homo sapiens
atgttgtccatgttgtccaacatggacaacatgtaatgcctcaaacattctgctaagcacactgcaacccacagtactatttcaacttatgttcacgttttactgcatacttgatgagttattttttcccccaaaggatttttgttgttgttgttgcttcctgaatgttgcacttttacaataaaacaatgttgaaatgtgaatgtctggtggttggctgggctctctcactgggtgacacaccaccatatactagctttcaggtgctcaaaagtaatttcttcctcaagagattgaaaaatacctatttgtcatgggtcttctgggtctgttagaataattaccaagtatttggatagttaaaagttgcaacgctagggtcttttatacttgctctaggacatagttgtcaggtatgaaaaatttaccatggcaagatccatttgttgtattaatcactacctttcccttagagttgatttatggttcagagggatattctggaaaatgcttagatcaaacaagaccacattcattcatggagaaagagtggaatgcaggttcgtagtaaagaaaaataatttccagggctcctgggaaaaagctttggtcacttaaatgcccttgggctttctgtaagtaaacatctgcagtcctctctattggttttctagcatatttcacacaaaagcaggggagcagagtagtgttaattaccctgagccaagtcagtattaatctcaggtctccattgttgtttaagattgatggataaagatgtgactgcccagaactacctttgttctcttactggaaagatgtggacttggaggggcaatctggagttaatagtcagaactagattgtatcctccttactgggatgtgagctctgtcacctgagtaaccaatttctttgtaaagggatgtaatctcaaatcttagctttcaagctgccaggcttggtttgcttttatatccccaaatggaaccggaaccttctttattccaatggtacattgtggtagactgtattcggcaaccttttgtatgaaagggttaacatagatctgtctcatcagtgtctttctgtttaaggatagcataaaagtgctgattgttaacttcacttggtcctatgcttattctttatttttactgtaggatttactt

SEQ ID NO: 13513 - DNA, 1376 bp, Homo sapiens
taaagagattagatattatattttcttattatatagtaccttaaatatgtctataacagataataaaatagtgcattagctcatatatactacctaaagagagacacttaatcttactgtatttatttggaaagtttaggtaatttcttacattaaaatatttttccttaaattaactgctgattcttagatcaagtcagttatgtattattgacctaaattccacgtacagtaattagtttttgttttgctggtcatactgagtcattgcgatatttctctggtatgtgattttagtcttctacatgccctttttttctcagtctatcaaggtacattacatagtttatttattctaagcgtttctacgaaatacaataattgtcactcactttttaaaggtttaaattcctaggctagcaaaggagtaagttattttcctatatgcagtcaaacctgggtgacacagtatggaagatgtttaatatctgtccatatgtctgtttattctttcatacagcgacacatgtgttgcacaactataacataccaggcatagtcagtagcgtctgggaatattcaagtgaagaaatctaagttctagctactccatggagaagatgcttttagactagaacaaggtagacaaggtgtgttttgcacgtagtctttcattttcatagtgcctggcccatgcttaacaccaaataggtagaaagtgaatgcatggacttgtaaccaacatgtgtctcatctggcctttcaaggaagtgctgtgtgaacccagaggaagtgctgtgtgaacccaggggaggagtgactacacatggttggcgtcggatgcattggaaaggcttcagataggatagtattggacttgagccaatgggaattggcttggtgaagacctccaggggacagggtgacaagccttgcctgcagtgacagcagcttgtgtgaaggcacagtgacagggattatgtgaaaagaggtgagctgtggttttcatgtccctgagggatctgtttatttgggccaataacctatatttcctttttttcccttggtcatgggtggaagatatttacctatatgactgattctgtacccagaagaggtgaaagcctagaacagatgatttctccaatatttaaagtgtaggttttgtcagcatctgcatgtgttatatagatatatatccttagcacgtggtgtgtatgtgtgtgcatgagcttgcctgtgtgtgcccgagtacgtgcctatgagtgagagagaaggaacttacttggcatgggatatgaaggaagatactcagtatttgttccgactcatgcatcccaacaaaggcgaagtaaatgtctctgtggtgtcccaca

SEQ ID NO: 13514 - DNA, 1216 bp, Homo sapiens
gttctttctaacgtgtcagccttttgaccttgagctgcattaaggctttcacatgtgcagttgattaagatttttattttcttcctttatttcatttgtaccatatgcacagagagtcgtggataacagtttagactaaataaaggacattgaattgtcagtaatgaaatatcttgttttaattaaaactattagtaatgctctttcttgccctggatactaggatattgacatacttaatggtagaataacagataatgcggtatttttttttttttttgctttttactcctacaaattgcttttaaattctctaagatctggttgacaattgccagtataagtatttatagagaaagataaagatggagctacctacactgtatctataaatacagctgtacatataaaatttgatggtgacagccatcttgcctgtttcagctgtgtgtgtttttaggaagatttgaatataaaagatttgtatttatataaattattttttgtattttgtgtggcttcataccctcaagggtgactttgaaaggtatcttgacccagggacaccaacgagtttattccaacaattccacgtggaagaatgtcagtgattccctggaggtcagagttccgtctccccctgtcttctcagcagtgtgatgaggggctcccagcacacagattatcacttccattccttttgggatgtagacctgcatcttatgtgttgcgtcttacttttgagttactgtgaacaactgttttcttcatctgccagttaaagacaaattacaaggaggaaaggatggaaaatacaggaaaagagtgtgaaagcccaagaacttaaagctctggatgtacagttgttcttttttgtggagtcaagcgtcattgtggcatcctctatgggtgttccaaaattacaattatagttagagaaataatataggtaattatgctgtcgaaccactgtaaaggagagcacgtaaaagaaggcagtgcggccaggcgcagtggctcatgcttgtaatcctagcactttgggaggccgaggccggtggatcatcacgaggtcaggagttcgagaccagcctggccaatatggtgaaaccccatctctactaaaaaatacaaaatacagaaattagccgggcatggtggcgcacctgtagtcccagctactcgggaagcagaagaatcacttgaacctgggagg

SEQ ID NO: 13515 - DNA, 1159 bp, Homo sapiens
caattactgatgcttctctgctttttcttcttctgcctcttttccacccttgccgggtgaccctttccagcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccaggtaagtggtgcaggtcttcttcgagggttcctgctcctgtgaatagtcgtaccctttttcaaaaaattgggagcagaaggtgaagcttcagaaggtacttaatattcttagaatcatatatgtctgtcatagaaaaggtgcacacatgtgaaatgtgtatgtgtgtgtccctgttttactccaaaagcctactctcttacgctggagtaagtctttctttgatatttgttttcttgcctcggaataactccagggacttcaaccaggcaatgatatacatgaataaaaaaagccatcgatcttaagaagtt

SEQ ID NO: 13516 - DNA, 1141 bp, Homo sapiens
ccaaatgaattgtttcactagcatgacctacttggttgtttgttttgagacaaggtctcactcacagtggcatcatcaaagctcagtgtaaccccaaactcctgggctcaagcgatcctttcacatcagcctcccgaatagcaaagactataggcatgtaccatatgactagttaatttttttttttttttaatttttttagagacagatctccctgtgttgcccaggtgggtcttgaactcctggcctcaagcaatcctcccaccttggcctcccaaagtactgaattacaggcatgaaccactatgcctagccatgctttttttaaaaaacaaaaaaacaaaaaaaaaaaaccttcctggtatttttcttctttccagctgtggtttggttaacacaacattgttgagagttacctataacacatggctttctcaggagcaagttctagtcattagattgtagatatgtgaaataaaggaagggatttgacccatgttgtattggttacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatgtatctgtttcttaattttaaaatgtagaccgtttttttgtttaatttcttgttgaaagcagtagaaaaggaagccagaattttaaaacctatcaacaacctcagcttgtgacaactccatgttatttctactgtggacatgtacaaagtgttgttgctctgtttacattttaatatgtcaaactcttccaagactccaggttcttctagagtatatgttctagaaaggggaaagtattatatcttagcctacagaggtagatctgcatgcatttagaggtgttatgtgttagtaacaaatgagtaaattaataactgtttaccttaattaaatactttttaaaaatccttacactgaatttcaaacacttgttagggaaataacctttaaaaatatgacttagttgatgagtagagataaaactactagtattaatgataatatttaaagttcatgatgtgttttaaagtcttcagtact

SEQ ID NO: 13517 - DNA, 1171 bp, Homo sapiens
gacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggact

SEQ ID NO: 13518 - DNA, 1186 bp, Homo sapiens
accttgcaggctcaagtgattctcctgcctcagcctccctagtagctggaattacaggtgcatgccaccacacccagctaattttagtatttttagtagagacggggttttaccatgtaggccaggctggtcttgaattcctgacctcaggtgatccacctgccttggcctcccaaagtgctgggattataggcatgagccaccagaccctgcctggatttttttttttttaagtgaagtctatcacataaattttaaagtttgattcaactagtagccatcttagctttaattgtattggctaataaaggataaacatgttttcatgtgttcatcgaatataaaatataggcaaacttgactaaggttttatgtttccttctcaattacagatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgcatatgtttgtgctcattaatattctaggtagtttttaactggtaacattgattggcttacaaaataagttgaaaattgttagaagttggcatttctaggatgtacatgggaaaatgagccaatttctggaaatggttacacttctgaaaacggagtctatgaagaggctttaggaggaccatgaacctgtgaaattacatgcaaaatgttagtggtgtatgcttattgtggagagaggttccaggctgttaaaattcgctggtatgggacgttaattataagatgcaaagtaaaatagtgcacattactttatatatctctccttaatatgagaggaatatggttctcaaatgttttgttgatctgttttctctactgttttgttctttaggaatcattttcaatagaaaaagatgtattgataaagtgaagagtgtttgaagtaaatagtttgttaagattgtt

SEQ ID NO: 13519 - DNA, 1618 bp, Homo sapiens
aagacagaagagcaaaaactgtatcatttcttaatatgattgggatcagggaatgggagaagatgggagctaagaatgtaaagtcagaaacttgcactgttttaaatgttaaagcgcttttgggggtggcttatgggggagaaaagggaaaatgctgtcagtagatggaggcaaggttacaggttgactcaataggtagtcacagttcttggcatgttgaatattatttgcacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagtagtattgaaatgtggcccggtaccaccttttttttttttttttttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagttaaaaatgaagcacttggtttcttccatcctcctcctccccttaatggattgtggc

SEQ ID NO: 13520 - DNA, 1112 bp, Homo sapiens
atgtaatgtccaagaaggcactttggactttgtttaaacacattttgaaaacttactcatgttgccttctagcagtggttctcttactgtgatattgggaatacctgtttggtgaattgctcttctaaaaaagaaaacaaaaaaaggcgccatgtgtgcgtggaacatacgatgttttacatctccctcttgagccatcacaattcaaaggctatgagaaggcctggagtagagaaacccattgaggcttgatgttgcatgttctgtgctaatgtgaccctggaaccccctttcagcctcacctcttaatgtgccacagaacacacttgggggaagctgttaaacttcaaaacggtggctccaccacttattagcaatgggacaagtcatttacatctctgaacctcagtttccttgtctgcaaaatggaaataattgggacacctaccctatggagttttagggagggttaaatatgttaagagatgtcaaggtcaccctctgcctgtcagcagggtttgtcccagtggatcattccctcctcttgcttccttctataactttctgtctccctcttactttatcttcctcctacctcccaatttcctttgctgctcttttctcctcttctaatttttttttttaggtcagccgctcctgcctccttcctgcttgctcatgtctttttcatctttattgctcccttgttgacgccatccagcccatggcttcttgttacactggactcttgactagtggagtcacatctccagcctggacctctctcctgagctccagacttagatacacatctcttctcagcatcttcattagatgtccaatcggcttctcagacttgctgtgtcaaaacatagcgctaactttttcctttccttaagccttgactgtgtcaacaaatggcacctccagctacccagttgcttgagctaaaaacttttggcacctttgattgttctctttctcttaccctctccccatatcctatccaatgggaataagtcctttcagttctacttcaaaaaaatagcccaaattgtagcaggtgagggtgagagggagggaggactgactagaaaggagcttgaggtaac

SEQ ID NO: 13521 - DNA, 1365 bp, Homo sapiens
agccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaa

SEQ ID NO: 13522 - DNA, 1257 bp, Homo sapiens
ttacaaagtctgtgcccacaaaatagactaaaatcatttaaaaatgcaaaagaccaaaaatggaacaggtgacctggtgccttttagggtgtcggaaatgttctctctcttgcacagagataggaagcccgtttgggaccattttttgctttggtcctagtcttcctttgctatctgcttagccagcagctgacatggtgagacaggtttgccactgtaaatatgatgcaaacttctggggcagctcttggcaaacagaagcatcagctgtgtcaaaacaatactttggctgagttgtgcccataagctgtggagccgttagggctgtttcatgtaaatagaggaaaaatggtcctgtaaatacattaattgcactgaagctgaatttagtattgtattaagtcatatccagaatgtttttttacccagtatggttctcagaagtcttaaccatccctgaaaccagctaaagagcagattaagtgaagtgacatggttaatacctgttgacatttctaagagtcaagggtttcaatggctggggtcgtgtctgcaggtgtaacactaactatataatcactatactttgtattaggcagaaatctagaagaatttggagcattatctccactggtactatttagctggactgttaagtattttcttccagaacttaagaaacgccactctgggtcagagagctctggtctgttgtatctctagtcagttcagtaggagcattttccctacaataatggcaccttccccagatgaacatttttgaagatcagaaataaccttagaatctcaggaacatcttctgacattcccaacttccctcatctcctattatatattatttttcgtgaaattccctcttaagctcattgtgttttcacccagttcactagaccaacagcaataccagtaccagagttatgttttagaaagtctactagctgtccacaaagtcgtagttcattaactttgacccaaaaaaaaaaaaatctcttaacccttaggaagaaacacacaaggctatttattgcatattcttgtggtttggtgaaaaaaagaaacctgcatttcccttcccagactcaattccattgatcatctcagttccattgattattctatatttacctctccaggaagaattatttgggaaaacagggggaaaaacataagtcttagagaattataaattaatttccatggtattctcttccttaaacactttctaaatacgctaaa

SEQ ID NO: 13523 - DNA, 1170 bp, Homo sapiens
ggcaggcggatcacgaggtcaggagatcgagaccatcctgcctaacacagtgaaaccccgtctctactaaaaaaaatacaaaaaattagccgggcatggtggcgggcgcttgtagtctcggctactgatgaggctgaggcaggacaatggcgtgaacccgggaggcggagctcgcagtgagccgagatcgcgccactgcagtctagcctgcagagcaacactacgtctcaaaaaaaaaaaaaaaaaaaaagaaactgaaggtagaatattggagttgctccatttgactggagcagggaaacaggggagtaagaagggagagaaatggggcttgggaatttgacaggggcctcatcattaggagacttggacaatgtatgatactcttggggccttattttgagagctgcaggaagtcactgaagagtttaagccagggagtgatataattagatttttttccttcacaaaaagcaggaccagaagcagaaagcatcagttagatgaggtagaagctgggtcagttgtccaggtgagccatggtggtgactgcaagtgttgacagtcaggatggagagaagtacgcagattagggagttattgaggaggtggaattagtaagactcaaagatcgattggatatagggatcaaataagaggggaatactgagaataattttctatatgggcagctaaggagatagtagtgacagacactgagacttgggcacttgggagaaagaatatgcaaatcttcttaagtgactcattccatttggctagacattggttcacagtatctcaaagccttcacagataaacctgacatctctccagccaagtctaatttacacgctccagaaatggcagatatcctattcttgtttctaaacacttggactgaattattaaaagactccttacagctaccatgtgaggaacctttaaataaaggtttcccaaatccgtgagctaacattataaaagctgtttcacttgattttcaaagtagttcctagattcattacttccatagcaaaaagtttaggagtattgctaactattcgtgccattgacttccagaatataaaatgaggtcagagttcctctgaaattatttttcttctttttaaaggcaaaataatgatgtaagtatggctatattgcaca

SEQ ID NO: 13524 - DNA, 1232 bp, Homo sapiens
aggctctaaatctagaccaccaagcaatactaatcactgaagacatccccaaaacacttggtctaaaaagaaagatccagactactgctttttatgttaaatatcaaagttccaatgaccggtgggaactttttggtttataagaaaagatatacggaacttttgttagaggacaaacataggaatggtaaatgagacaaattgagaattttccacattagcatctgccttggtcattgaacattaaaatagaatagggagagtaacttaacagtcctcctgggaacaggagtgggttttgacattttgaaggtcacatctctgtccccaagggaagcacagaggaaaagggaatcaggttcattccctaagcccatctcttggcttgtatgggaaaggtaccaatggcattgatggagcctgtggagcaccatgctgattgagaaaaatattaaagcagcgaaactctcttttcaaagggaatcaaactgtaatcccaatttctaaaactgatcaaagaggagcagttctgtttgaaatagagtttgtagcctggaggccagctcagtccaggctgcgtcacacaatccctatccccaggtggccctgtaagactgaagcctaaggctctgccaaatgtaatttgaaaaacactgttccagaccatgctttcaagaggagcagttgtacatttctcctggttcggaaagcctcccatcagaaaagctaaactaatgactaatagataaggggtagtgtggtttctttggtatcagtgttgatcatggtattgagattaaccaggttggaccctttctaaggacatttcagtgtacataagcatcgttcccatagagtgtccccagcatccctgggcacatacattatcaacttagcatccatacagaaagaaagtaaaatgtagattctgattcagtggatctgggacagggccccagctctccatttctgataaggtcccttgtgctgccattgctttgaatactagggtttcaaaccagaattggtgcatcggaatctcttgcgagacttattaaaaatgcagatttttggccccatcccagagcttctggatccagctctctggttatgggtctggaggtttttgtttttaacaggctcccaggtttttctgatattcactatatttgacagctatactctagcatgtgtttacttacatagcttactcttgaagaacccaggaagag

SEQ ID NO: 13525 - DNA, 1214 bp, Homo sapiens
gggagatgtccaaccacagatctcaggcaatcatatttctctggtgatgtgtttatgcagcaggtgtcattttctttaaagggctttggaacttgccggttgtattgaggaatacgagaatctcaaggcctgtgataaaaacacaaaccccttaggctctgagcttaaggtggatacgtttttagtatttactggagtcgtaaaagctgctgactgtgaatgttgtctgtataaaatccagttcaccttttttattcagtgcattatcaaaaatggtataaaactctctctaggttacccagcggtgcttggttttctctctctcccatttggggtcccaggcactagagtgtggaaatgagaatgctgttgtgttgtattagaaagaagttgcctttactgtgtccctgtctggacagatgaggcagcagagtcttaggtacgccctcttactgaacaggttattttaattacacctggatgtggaacttcctgttttagttgattgatggtttgttgtgcctttgtattttctgctacaggcacaacccgatctcccagagaaggagaagtgcctggcgtggactataactttctgactgtgaaggagttcttggacctcgagcagagtgggactcttctggaagtcggcacctatgaaggtgagttacttgtacgacagcataaaaagcttctctcctgggtacttgagaggagccagagccatccaggcaaaaatgttttgtggaatctggaggtctaaacaaataacaggagatttcagttcaccttaatatgacgaataatagacaaagtctatggaataaggctttgtggagttctttaaaaatagttttagtttttctctaggagttttcttttttaatttacctattcaagtatgtgggtgtgttttgtttttaatacggacatgtgcggtattaggagagaaggaagaatcatggttaatcacaaaatgtgatcctataagtagtgttgttttaatcttgaagaaataaaatatcactttcctactgattggtttttaatgtatttttatgtgattcataaagcaaacttttttttttttttttttgagacggagtctcgctctgtcgcccaggctggagtgcagtggcgcgatcttggctcactgtaagctctgcctcctgggttcatgccattctcctgcgtcagcctcccgagtagctggg

SEQ ID NO: 13526 - DNA, 1346 bp, Homo sapiens
tatcacagaccaggtggcttgaacgatggactttgttttctctcagttctggaggctagaagtcccagatcaaggtgttagtaggtttggtttcttctgagaccttgctccttggctgccagactcctgctgttatccctctgtgtcctcacctggtctttctgctggatacatgctcattcttgtcctaacctcctctttttctcaggacaccaattgtattggattaggcgcacccatatgacctcattttgccttaataacctctttaaagggcctatgtaaatacattcacattctgaggtactgaggattaggattttagcagatgaattttggggggacaaaactaagctcatagcagggaattgcctaaagatttttttgtgttttttttgtctgtaggtatttcttgttatggatataaactcaaattttggagttttgaattatctgtttttagagattgtttatctaaaacctttttacatttgaataaaacgtttatgtggttccaaagtaaaatctgaagcctgttcaaagaaatctggcttccaaacttcaacctcatttcctctgaatgtccttctctatttgaccttggtataatacagttcatagtaattgtttcttactagtaattatttcaacccttctagactgcaagcttcatgaaggcagaaacttttattctcttgttcatagcatcatccacaaaaaatctaacactgtacctagaacacacttggtgtttggtgactagttgttgaatggacatgtggcattggagtttaaggtgtagactggaaccagtaggtttgggaattgtcttcattgtcttcatagaggctatgaaaatggatgagacccatctagtgggatgagttacaaaaagaaaaggcaaacagttgaaggtctatatttaggggacagaacaaggacggtaagcagagagaaaaaaggaacagttggagaaatggtaggaaagtgggagaaagtctgtatcaatgggcattgggaaagcatatatttaaaacggactccttagtcaagaagggcatggttgaaaagtgctgaactggacactggaagacattggttcaagttttgcttctaccttgatttgttgtgtgaccttgggcaaattagtctctgaaaatcagtttcttcacgtgtggaatgagaatcactgtatctatctgcattgtctacctcgtagggtatatgagcttcaagagataatagtgttaactcaaatctagaaacttcttagtgctttagaaatgtaaggttaaggctgggcacggtggctcacgcctgtaatcccagcactttgggaggccgag

SEQ ID NO: 13527 - DNA, 1226 bp, Homo sapiens
tcttttagactttttttttttttgagatggagtcttgctctgtcacccaggctggagtgcagtggcacaatctcagctcactgcagcctctgcctcccaggttcaagcaattctcctgcctcagcctcccgagtaagctgggattacaggcctatgccaccacgcccggctaattttttgtatttttattagagatgagatttcaccatgttggccaggctggtctcgaactactgacctcaggtgatctgcccaccttggcctcccagagttctgggattacagacatgagccaccacgcccggcctagatattttaaatactggcagagatgaggactgcttcagagatatttttcttgggtgatttagaaggaagatggtggaatataaagaacttggtggacaaacacttaggaatcttctagactatatcctgattttatagtatcaggcacatagtaaaagcttggtataaagttgagcaaatgaatggattttgaaaggactgaacttttaacattagaatatgaatattatcaccatgggaaaaaagatacattatttattttaacaagtgatctcaagagtgataatgagatgatgtggtatgaatcatctttgtatgcctagacgtatctagcatccaggaaaatatgcagatgtctttgtagagagaagtcatgtagggtctctttctttttttttaagcaattgatagaatgaagtttatttaaccctgtctcccatttactcctttcttcaaaagctaattttcatatctgttttcagacttttatgtggacagatgtttcagggtttgtttgcaaacatttcccagacatattgttgatcagcaggtttctgcaattaacagcatcttcttaagcctgtttcctacattctgattgactgtatgacaaatgctgtaggttttcacagatgcagggaaagagaaggttaccagctcagcagaatcctgtggaaatcagatatgagtcttaggacagttcattggaaatggaattcagtaaaaggttgagagcgcatgaagtagtgtggttgtaggtggcgtcttgaataaagtcagctgttgtgcatgcaccccagcagacactggggaatgcacagacacattcactcacacacaatatctcctttaatcgtctgaagaattctgggaaaagcgactggggtctttatttcagcgatgaggacagagaggct

SEQ ID NO: 13528 - DNA, 1097 bp, Homo sapiens
gtagctgggactacaggtgtgtgccaccatacccagctaatttttatatttttagtagagactgggtttcatcatgttgcccaggctggtcttgaactcctgcttcggcctcccaaagtgctgggattacaggcgtgagccactgagcccaactttttaatcacacagattctagtagctgatgccatgtgtctgttagggatgacaagggcaggaactacaaggggagaggagagactgtaataggtaattagagaatgggcttcagagttcatcagacagacccagttcagcccacttatcagctgtgtgacttgagacaaatttgtgattctttctaaggttggtttcctagtctgtaaagtgggaataataataataaccatcatgaaatgataatgctaccattttgctcctttctatgtaccaggtattgtacctagactatcaacttcaaaccttataactctaaattgagttgtagaactcatgattattcccagtttacagatgattctgagcacagagaggttaagaactttgcctgagaacacacagccagcacatagtagagctgggattatgtcacaggtggtcaggttgcccaaggttgttataatatgtgaagctttaagcatgatgtctcctaggtaacatttattccaagtgtaataacatgatcataaggtaggctttaattgttaaagagacctgtttcttcccttaatcgcctgacttctctctgcttggaacctttactcccatattcagattctgcctactgtggtggattggggccaggtcttccactgtccttagcaatgcaaaatgattgccgaaaacagggggcttaatggtggaccctgggactcccagcgaacttaaatgcttctctttgctctccgcttccaccttaatgtctagctttgtatcaacaagttgagaaattttcggccgagtctggtgcattgatgagctgagtcactcccaattaggctgtgggcctgcctggtggggatactcttgtttaccaatgagcacaagtctttttggtggttgtttttcaaacgtggattgatggtatggaagccattcta

SEQ ID NO: 13529 - DNA, 1160 bp, Homo sapiens
ctgatgtgggaggctcgcttgagcctaggagatccaagctgcagtgagctgtgattgcacttctgtactccagtctgggtaacagaccgagaccccgtctcagaaaaacaaaccaaaaaactgatattgctgattaaagctttcacttgaaagcctcaacagttaatcagaaacgtacaatttataattagtgtaaattgagcataataattttattatagcttatctcagtgtattcatttgatgatttaaaaatataaatataggagttttcatcccttaaatttatgtcagaatttagagacatgttgtattattctttgtgttcctccattttaggttgattgtataatttttccaggttttaaatatatttaggagatatttataccttacatatgctgtttggggtattacaaattctaatcccagaattactatagataaaaccataaatataaaatgataggggcctattatcttagcattttgttagtctgcttttaggaaccatttgctatggcttaccaatacaattttctttcaacattaggatcctctttccttgaagaactacaggaaacacaagctcgggagttattttacataacaatgaggatgagatgttatttgtttataagttattcagtgtctaaaagccttagggtaccaaacataacacaagatagaaaagaaacaaatttgccttgacatttagctgtaaattgaaattaattcatataaaatactgaggtgaaacacttcagttgtagagttttgcatactgcttagctttcatgattttgtcactttagattttagttcaaaagtgtgcttttaaactgtataaactcattagctgcataaaattctccagctatccactttttcctatattttcttactctgcaggtgaaaacagcatttttaatatttaacattcttaagtgatctgtttcatgtggattgtttttcgttttcttgtccctggccctacctcttctggagtcagcgcaggctggtgggtgcgctgccagatctgggtgtgcgtgtgtggtgtcaggataccattattgggaaatggatgactgcaaaacagtgaggcctacttgtaggcagatgacataaccagcagctcactgaatgccattgccaagaca

SEQ ID NO: 13530 - DNA, 1221 bp, Homo sapiens
atgagactgtctaatttttgtatttttggtagagaggggattttgccatgttgcccaggctggtcttgaactcctaggctcgaacgatccgcccacctccaccttccaaagtgctgggattacaggcttgagccactgtgcccggcctaaaaaccatctttcaattcagacttgggtaataaggcattctagaaagtattttcttaaattttatgccttatataaaatgtcgaagaccccagcatttcaatatgctggtatgaagactagaaatgacagattattttgtggtctaaattctttttcctttaagtttggcctgtgctccataaagagacagacataattttggaaattcgctttcttggcactgatgtgtttgctgagtcaagtcttgaatttttagaatgaaaacgaactattgccatgagttgaaagttgggcaggaagaacatttcaatcatttttgggttaggaagaaaatccaagttgacatttctcatggatatttactgtttttttttttttaaatagctatttcccttttaatctttgcaacataatatgaatgatttgaataagtttttgcagctgtacaaaaataaccctgcctatggtactatgttaatttgttactggctttgcaatttagaagatttgattatttcaaactccacagcctctatgatgtcctccaatgatccctgccttcttgtatttacaccttcgtgcagtctgttcccaggtctgtgagaccaatagcctaatgatggcgtttcacttccaggataaggttataaaaatctgccttctgtcctagtcatcctttctatttccctctctcttggatctcttgctctgggagaagctatgctgtgagcagtgctgtggagaggcgcacacagtgaggaactgaagccccctgctgacagccatgcgaatgagcttggaagagtatcctttggaccagtcaagctgtagatgactgcagccccactaacactgcagaggtgtgagagatgttgagccagaaccacccagctaggccagtcttggattcctgacccacagaaactgtcagataataaatgcttattgtttgaagccaataagactggggttacttgttacacagcaataaataactgatacaaactggcaacataaggttggttaatccatgcatccatccatccatccatccatccatccacccatcca

SEQ ID NO: 13531 - DNA, 1412 bp, Homo sapiens
aagatatggttacctagtttaactaaaatgtcaagtttctttacttttaggtagagtaaggttaactctgtgtggttacagtggctctctcgggggcagataggttacttattagttcgaaagcacaattggggaacacagacttctcgaactgggctgtatttgcaaaacatgatgcaactagttcttaatggcaaaacgattgtggagcattggtgtgtcctattgtggcttaaaagggaacttagcaatcagataataaagaaaggaataaaccaacattaataccatgtgtagaaagtgatttgagatggagaaaacgattaacttcccaaggtggtctgaaagtatatgttaaaatagacttgttttattcatggaatatttcaccatatatttgccataaggcctgaagactctgttaggtgcttttcccatttttttcccctcacacttgaggggtaaagaaagatatcggtaggtcataatcatttatacatgtgaaattttgatattgcatatgcttggcacattgaaagtaagcatatcagtaccatagatgaggaagcatattgctcccagattttattgattctttctcatttctgcctgtctttcctctccttatccccctaaattataatttcattgaaaaagggcttcttttcaacacacactggtgcctgtcagggagtgcggggttgtgcggaggagagcatcaggaaaaatagctaatgcatgctgggcttaatacctaagggatggctgataggtgcagcaaaccaccatggcacatgtttacctacctaacaaacctgcacatcctgcacatgtaccccggaacttcaaataaattttttttttaaaaaagggattcttttatagcccttaccttgagtgataaagggtcagaatgaaaaggtacttctagaatgtaatgcgattttatccccatttagatgtgattctattctctgttaagaaatgaaataactgtaaacacaatatgtaagtgaactgttaaactacttccattaaatgtttcaagtaatggaaatacatcaacactaaccctacaagctatgtgccttaaaagttcatagcctcatttttatgagcttcaaggctttttgcattagatgaaaggaatagtaccctgtaaaaattggtatcttatgggcttgaagctttcaccagcattttaggaaaggaaagggtaaaaaaaaagaaaaaccccccaaaaaaaccatcaaatggtttcagagtataatctacaaatgggataagtgatcattatcttttggctctagtcaaataaggaaggcctaacagattagtcttggtctcttaaatcttaacctctaaatatgtaatttttattaaaggagtatattctagagtaaaaactaggc

SEQ ID NO: 13532 - DNA, 1663 bp, Homo sapiens
aggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaag

SEQ ID NO: 13533 - DNA, 1181 bp, Homo sapiens
gggcttgatgatccagtggggtggggcccaccctcaagactctctcctccataaatggtgcaaatgagttttggagaagtgctgcttcaggagagggtgccaggggcttggctgatttaagctgtttgtttcacccgaaagaggttcttttctgtgctgtcaggatgtgggcttattaggacttagtgggacacttcttacaggagatttgacaggaaaaaaaaggcattagacttctgtgtaaacatggtagaatagaatagtcttcttttacttctaacaaatctggtgcatgagtcaaatcccgttcagttatgggtaattagcatctctgtagaaccattagtacctttccagaaaaggcctagcttaaatagtccgcatttcggttgaataattggacatttttcctagaacataggaaaggcacagcagtaaccttaggcatgactatggctgttttaaaaagagaaaactggtgtcacaagttgtaaccagcacctgtggcttgatcgaagaaaatgtggcctgtgttctgactaccgtgaagggaagaaaagttaattccttttaaatgtaaagatcctgtacctctcaaaatggggcacgaatctttaacttggcccgagacactgctccatgaacaagtactacagagttctgaagacaaccaggaaccctttagttacagttaggttttcaatatctacttcttctgtggaatttactgagttagtgaaaatcagtggtcgtagggtggaggcagagcttttgtgaagtactgggagatagagcccagtattgtccttaggtagtctcttatttagtctggggtattgtgatttttcccttacatacggtagtttttttttttttttttaaatagaatcatgtgggcaaaatcagattaacttcttaagtgttcacctgttggaagagtgactcccaatgccatgtgtcagtggcattgtggggaaagcacttagttccacagaagtaacttcccagagagggcagggtgtcctcttatttgcactttcctatggtcacaagatccactttgccttgccctttaatttttggagcaaaacatactggttatttctttaggctttctgttgcctaggagtgacatttcacatggcataaataccttcaaaattgaagtccttctcttttac

SEQ ID NO: 13534 - DNA, 1062 bp, Homo sapiens
aagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggtaggtgcctaagtgatttagtttttcatggaagggtaacacatcaagtggtggtttacttaattatactgaaacagttgtgttcccgttaattgaggaatacctccagcttccttatcaaactattggaacagtctgttctgtaaagagctataaagaaaataaactcttgaattaaaaaaaggcaggtattgttaaattactaaaataatcctataatttttaatgattttgtgtcttgatatcatgtagaataactatttttgaaaacattctttaataaataatagttcggcattttgggataactatttcagagtagtttgtaggacttgaaataaatagcaaggttgttacatggctgtttttgctcttgagtaaaattgagatgttgtagcaa

SEQ ID NO: 13535 - DNA, 1150 bp, Homo sapiens
agtgattctcctgccttagcctcctgagtagctggaattacaggtgcctgccaccacacctggctaatttttgtatttttaatggagatggggtttcaccatgttggccaggctggtctcaaactcctgacctcaagtaatccacccgtctcagcctcccaaagtgctgggattacaggcgtgagccactgtgcctggccagaatcaagctcttaacaattctgccatcaagcccaagtaactccttgtaccttcccaatacaaacctcccaattcaggttgattataatattatctgttatattgtgtcatggaatgacaaagttttaaggtattttgtaacccatatgaatgtatctctggagattataaaagaaatgttttagaaagtgaaatatatagcaaattatgccctttaatctttagaggttgtagttacaacatataaccaaaaaccaaacataaaaatttacatattcttgttttcttttttttttttttaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaa

SEQ ID NO: 13536 - DNA, 2369 bp, Homo sapiens
ttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggca

SEQ ID NO: 13537 - DNA, 1332 bp, Homo sapiens
gtgattgttccctgtcccccttctaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaagatctgtgtgtatctctcattttactcaattttattcctcaaacattttttttttttacaaagacactagtcttagtgtcttaggtatgcctctaaaatttgataatttgggtcattccaggattattccagttccactcaactttatcagatacccatttctgt

SEQ ID NO: 13538 - DNA, 1190 bp, Homo sapiens
tagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttg

SEQ ID NO: 13539 - DNA, 1634 bp, Homo sapiens
aggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaaggtaactctagtaagtggaagggatttttagatgtgctttttggagattaaatcatttgttttaaaaaatactttcattgatgcataataatttatacagatttaaaaacatacgcattttgccatttctgtgtagcattaagtaccttgaagttgaacaattattaatataatttggaatttctccaaggcaattatggtagaataagttgatacttcaatacagttaagcatgaaagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatga

SEQ ID NO: 13540 - DNA, 1260 bp, Homo sapiens
ttagacatattaatagaattaattgctcttttagtagaatattttaaaatctctaagaaatcaaatattactttgattaaagaggattggattttgatgtttttctagaccgtaatactctgtagtttgtttacatgtgtattatcctttctgttgagttttttttgcttgtattaataatattttttctgttttagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgtacttctttcactgaagtttttaaaagtacattaagggtaatcagtagttccatggtaatataggaataatttttaaatgtgtagcagagttatatcaaatttttattgcacttaatacttttgctacagcaatttctatagtaaaaatttactggtttaatttaactttctgtatcaatataattttttttttttttttttttgcgacagagtttcgctcttgttgcccaggctggagtgcgatgatgcaacctcagctcactgcaac

SEQ ID NO: 13541 - DNA, 1108 bp, Homo sapiens
taatccaagaaactttgggaggctgaggcgggcggatcacttgaggtcaggagttcaaggccagtctggcccacatggtgaaaccctgtatctactaaaaataaaaaattagccaggtgtggtagtgcacacctataatcccagctactcgagaagctgaggcaggagaatcacctgaatctgggaggcggaggttgcagtgagccgagatcccatcagtcactccagcctgtgtgacaagagcgagactccgtctcaaaaaaaagaaaaaaaaaagaaaaattaacattgaaacttcctgaaatcattagagttttagaattcctggttcaatagaattcacaaatttcaaataattgagcaaatacaaagtctcctctttatcctagtggcattttttcctggaaacatcagaaactattttaaagtttgttgctttatttatagtctttgcggttatcacccagcttttaatatgcctttccattctttacagtctctccagttcttgttagatacatgtaaagttctagtcattggagctggcggcttaggatgtgagctcctgaaaaatctggtaatatatatacatatatatataaatatttttttcttctttgtgataagtaaaccttacttatctgtcatactagggaatttctcgtgattcttaaccttttctcttgagcctttgttagataagtttagcatgccaaattccaaacagtaattaaaatggtagaactttggaactttttaaattctaaagctctcagctataaagttattgataaaatttcatacttcagttttcttctctgatctttaacaaacaacttttggtgcttcctctggcaaaacgctcctaacttcaatgaagtaaataacaaaactggcaattcatattttaatgtatagtttcaaataatttattatttcttttgcttccccaaataacccagctaggtgggtaaggcattaccccattttatatagagggagacattgaggtttagagatgttgactgagttgctgaagtttttgtggattatagcgatttgcctggaattgaatccaggtcatcagttcttagttaagtgttctttt

SEQ ID NO: 13542 - DNA, 1157 bp, Homo sapiens
agcagactggactgtggctaactaaggcagtttactaatagtgtgaagagagggagtgtaatattgatatggcaaaagagaattgttgctttggtgttaaccaggtgtcccttctctgcagtgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaag

SEQ ID NO: 13543 - DNA, 1179 bp, Homo sapiens
aatcagaacagtggttgcctaggaatgtgagaagagtggattgactggtgaggggtctaaggaaacttcctgggctgatggttgctctagatctggatgcaagggtgggtcacataggtgtaggcatttgtcaaaacttactgcatgcagattatgttccattacaaaatgaaagcttgggtactagcactttattggggagtgcaatcccagggaagcaggtgtgagtgtgaataagaaggagtgagcagggagggcaaggaggtgaatacaaggaagtgcatcatagatgagaaagctggctttgtgacaagctgactacatggtcttccaggggtgtcttgggagaagccatatgaaattattatgcttctgagcagtgcagggggagagaggaagaagagttcattggtcatttccctgagaggccaggaggaatcgcctgccacaagtacctcagttggtgactgtggcagaggccttggctacctggctgtacagcaagccattgccagggcctctcaggccagaaacaaggccagtgcacagatattgggtgatgcacaagtgactcaggtgtaggcacagggagttctatgcatggttaagggtaagctgtgcagagccagaatgcatgagtcaagatcctgtctccaccactcaccaattatgtagctttgggcaagtgacttaaccttaccaagcttcagtctccctgtagctgtgctgttagtggccctgggcctaccccagaagttgtcttcagacagttctcatgcaccctgacaaggctgtttgtgtcttttacctgagggctttctctagccacagaagtgaactgcttcttgctatgggacaggccagacatcagggaaagagagggaacatttccaggagtgaccctcaaccaatgaggagtaaaactgcaggataaaactgcggcctcctagcccctccatgggaacattctgaggcatgctcacacagtctctcagacagttcccggcaagactgagctctggttacttgcggctctggttactgttcacgaagacaccatgttttggcatccttcccttccctgactccattcctcacttccctacctatgcttcctggtaatatttcccagaaaaaatcctcctccctgactccttgtctcagcatctgctttttgaa

SEQ ID NO: 13544 - DNA, 2487 bp, Homo sapiens
aagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatagtggtggcctattgtgttaatgccaattttgaatgctatctgccatatcaaaaaatggtagtgcacattttcttctgatttaatgaataacaaattgcatgaaaatttagaaaatgccagtaagtactttttttgtttaaaatgccactctaagatgttactttttggttttaaacatttttgattactttttgacttacactcagatgaggtgtaattatgcaccttttttatccccctctgaatttggggagattttaaactcccaaatgccaagacttcattttagatataggagttttatttaaaatgtttcattgagaggtggctttaaaaaagagaaattgtcagagaaacccttgcatatttacagaaaagatattgggtttttaaaatacaaatttacaataatgaaagcttaatatacccaggctgccagctcctggttgccttttt

SEQ ID NO: 13545 - DNA, 1304 bp, Homo sapiens
ctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttc

SEQ ID NO: 13546 - DNA, 1198 bp, Homo sapiens
aaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattc

SEQ ID NO: 13547 - DNA, 1105 bp, Homo sapiens
agcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcattctggagtggttgttttgttgtggtggtggtggtgtttgaggctgtaata

SEQ ID NO: 13548 - DNA, 1268 bp, Homo sapiens
tagctgggtatcttaagtacatacctcaaagatgcaaaaggagacataatggggcaaaagaatcaccaaaatttgaaagaaaatgaactgtctcctaagtgtaacctttgagatagattgcaatgatgtaaaggaaggaaatgggatttaaggaaagaaaatggagatgatgctaaaatatgctaattgaggactgaaaatcctcaaaagacaacccctgtttctggccaactggatttaggtcaactatgtctcagagatgtgaataaagtgtgttactaacctaaaagccacacaagctcacttattgccccatgcgagggagactcctgcctgctgctgcaggtgctgaggcataccagtctataaccttccaaagaattaagaaaccacttaaaacatgtcaagatccatccccgattattttgtcctgggtctgcacctgaactagcactggaaggaagagagtgtaaatagcgcaggatgttgagttgaaaatgggtctgttctgataaaacagcaagttccattcttcgtcctcattttttagtactgaacgtgacccaagtttggcccctcagaagtcttggaaaggatctggaagggttgaaggacagggattggatggggtctctcatgtttcccacaggccattttggatacagacgtgcgatctgctaaccccatgcccctctgcttgcttttgtgcctgaggagttcactgtgagggcccccactgctggtggcactggtaccatcctttggaggaggatgggaattgtctcccataccaggtgtggaccaaagcaagcacttggtctttacaggggaggcacaaggaagagtcgtttctttccagttgtgtggacggaaagggaggcaaaaaggttttctctaatcctcagccaaactctagtgttaacaccaagtgtccagatccccattgagaaatcccatggctagagtgtgacaggatcatggaagcagctcttgctcaattattcttgatcaagggtggaatgacgacttcagccagcaagggcccaggcttgtgctctctgatttcatagccctacggcgtggaaatggaaaccagccagactccaccttgggcagtgaagagaacataagggacgtccaggaggcccttggtctagcacgcccctgacctcccagcggttctggaaggccactcctaacccttcaaaccatagcaaggaaggttagagctatctttgtgttaggatcaaaactcgagaaggttctgt

SEQ ID NO: 13549 - DNA, 2785 bp, Homo sapiens
cttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttatatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacctctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaaaaaaaataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactc

SEQ ID NO: 13550 - DNA, 1194 bp, Homo sapiens
gtatttttagtagagacggggttttgccatgttggccagggaggtctcgaactcctgacctcaggtgatccacccgcctggagtcccaaagtgctttacaggcatgagccaccactcccggtgagttctacatttttgatctgtgccatcttgaatagccttagctgacaaaaacatgaaatgtaaattatattaaaatgtcctttatgtgcatctgtattttgttaatgccatgtgttttagattcttatttgtaatctttaggactttatttaaaagctttcttgtgacatttgtgatgtattgatagtgtgagaaattacaaaaactaagattctgttttattgtaaagtatacaaaaagaatcttatttcatggttttatgtttctcttctacttggcttcacaatgatccgaacttgcagcttttaaatgagaaaagcttcctatttcattgtgtacttttgtttgtgtaacattttgtggaaatgactgcttattaaaatgacacttcacagacttggactaacgttcatgatatcatggtgtcttttggaagaagggtgttgtgttacccactctatcgccatttcaagctggtgatgaaggcctacagggacactataaagatattgcaactgggtaagatattactgtacttgcaaatttgggagggaaaaagttgtaagtttttagtctgtgaagatataataatgatttttgcttttttactgtatataaataagtaatgaaaaatgaatccaaccacttttaaagtatagaattcctgtgtataagacatatgtagataagtaattgcatagaggcataataaagactcttttccgagaggagtaaggaaggtaaacagagaaggcacacatagtattgcaaaccgttttacattataatagctgcatcattcagtatttcttggctgcctataatcttctaggctctatggtgggactgtgggtctaataataaagaaggcagaaaagttccctgctctgttgaagtttacagttttgtcagacagatgatgggtaagttagcaattccaaagagagtgaaaagtactctgctgggagaagtccagggatcgtttaggaggggacatgtaacctagattcggcatgtcaagaaagattttccaacaaaaagctcagctactctgagcacttttgacttgct

SEQ ID NO: 13551 - DNA, 2292 bp, Homo sapiens
ggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaaatttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaa

SEQ ID NO: 13552 - DNA, 1189 bp, Homo sapiens
ccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttctatttgatatgttttgatgtgattcctcattttgcagtggtgcctataaaataaaagccttttgcagtgtttgctttttttcccttggttgtggttgtattacatgctactttggaaggatttaagtattttagaccatctgatgtcttcacattcagcctcaaacctaatgatggatataaagcgaaggtctagcagtgaagaatacagggtcaaatttacaatacaaccctgcattctcactgcctgtctcacaggaagtttcagcctggcccaatatcctataaacaagaatagctatgagcaactttatcaatcaatcagggtcatgtttacagtgaaatctctttcgtttattgcaaccattactgcctatcagtaataacaactccgggtggctaggtccagctttccatttctaagatgcatctgcaaatcaggcaatattttcatagaa

SEQ ID NO: 13553 - DNA, 1977 bp, Homo sapiens
gacacattaaattataataataataaatgcatataaataaatataacacaatcctcttaagatttattttcaaatgtgacaataacgtatctcttacaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatacatctttctttcttgtgttgatttcttttttcattgtgtgctgatcaaatttattccatttaatcacaaagtcgttctgtcttaacatttcacccctgtattatcagatgagtgaaaattctcaattagttgtatgaataaccaggctttactgtaagcaaaattttacctaagtcctctgaaattaaaaa

SEQ ID NO: 13554 - DNA, 1179 bp, Homo sapiens
ctactatgtatccacaaaaattaaaaaataaaaaataatgaaagcaatggaccaaaagttctaagctgcacaggaaaagctgtaagtctaggagataaatgataaaagcaaaggtggggtggagtgaggtctaagacctggatgtgttggtaacttttggtgtcctgacaccaggtataagaagaacaagaaagttagaaaacaaagctgtcagacatctgagagagacctgagagattatgttttaggactccaacagtccccagtattggtcaaggttcatggtatgtggacaatagaagacaaagctgcaatagaggagattaaatttattataaaagatcttttaaaaaagctgtaagtttgcatgcctcgtctgtatagatgttaagctagcccaagatgttggtccaatttgggaggtcatgcggaggatgtttgagactgaattatccaaattctgattcaacaaaggtggtggctgaaaatgatgaaatggcatagccagttgtatatatgaatggcttgagctctaaagaggggacagttttttctcaaaagtatagattaatgaactaaaagtccctgtgagatcaagaagaaaatgttagcactccttctagcactggaaaactgaagcagtgagagtcgccccgtgttctctcaagttaaccagattttacataagacaaaaggtatgaagagtgtgaaagagattgaaggtaaagagtagatcattcataatttccccctaacatgtagggaaaacagaacatacaggatttctgagaccataaaatgacacttatcatttatattttaaaggcattatttattttcattatgtgtgaaatataatttatgctactcaaaatgtcagtcgcaaatcattactgagagtgaatctattctttattccaaagtgctgagagattatggaaaagtcctcattcttagtcgttaaaaaattgttcatacttgaaccctaatttcatttgtaaatttgagcgaaaagttgaagtcgggtccacattaatgcttttgaaatgagaatgctattatcaatatcaatatcttagctttaatctttctcttatttttcaccattaaaagtgataatcttacttttattcattctgttcccccgaggcacaaaaccagtgatgacttgttgaattt

SEQ ID NO: 13555 - DNA, 1195 bp, Homo sapiens
taaccaaccaaagttaggatgtgagagaagaggaggtaggaggaagtttgagaatatataatctctttatcatagggaactccatattgcataaattgaagtgtgtgtttgaaataatatataaatattatgtctcagttttatgatggttttcctattttcttttccttacctcagagggatctaatacaaactaacattaacatcttaatgtgacagaaaatgtattgacaattatttgatatttagaattccctttagtatgatttcactttttgccatataatttagctaaaattaaattaaatctttaaagtgctttgtttttctcatgcgtgtgcatttgtcaaacaaaattgatttgcagaattgtctgaactctgaatgttgacatgtagtacttttctaagtcagtatatttgctgatgcttatgttattaaactgctacaataacaaaattcatataaacaaactaattggtgaatgtatttgtgcagagttaagacttgcttgttaacataatatatccgtattgattttctttttctaaggtcaaggtttctcaggtgattacagtgaatatttcggactacaagtagatgaagatgccttgacttacctcatgttggcaaatcatttggttcacacgctgtgtcccgattctataacaatagctgaggtaaagccatagtgaagtcttaccttctgaccccctttaatagagagtattttgtcagcatacagtatttgattaatcaatctcatgttgtcaataattgcgtaaatgaaattctaccctgagtatagtgcagctatcttgtatgggtggcacattatttagaattcactgtttccctattagaagataatgtatactaattacttgtcaccattctgttgttaaaaaagaaaatgccagtggttggagagttaaatgtcctaatcagtggacaggcccttcgctatgagaccttcagcagagaaaagaattgaatattaatgtgtgtctgtccatttattattatttttttcttttttggctcaatcattaaagataggatggattgctgcctgcaagcttctctgaagcctttcttgttctgatgtgattacctttcttgtttatgttattgctctcagattgccaaatgttcactagttattcatgattgttgaaggttcatgattaactgt

SEQ ID NO: 13556 - DNA, 1281 bp, Homo sapiens
ggccccggaccgccgcggctcgcctcggcttgcctcgacacgcctaggcgccctccggctccgccctagccgccgcgtcccagctagagctccagcgcccgctcaggccccactcgacctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtaccgccggaatcccaccacccccacttagacaggcagcccgcctcccaggagccgtctcgggacacgggccgcccctcggccctcgcgcgccaaccccgccccaggcggggaggaacctgagtgggcggggctcggggtgactcgggtaaccgggttctgtggcttccgtagtggcaggtttgacagcgctggtgcccggagcgggcgctgaagaaacttctttcctcatcccctttcccctctgttctaatcagcggtcttgcgccatagggtacgtgctgtggctccaacacttattccccagagtgctgctggggagtgactcaccgccgctgcaggttttctgactttggcacccactagcgtgggcctgtggagtaacgtgggcataactcctggcacgtgtaattacgcatttaaaactttctagtttatttcatagcaaatgttgtgattttatatctaagaggattccttcaggcagacactatatccttttgttttttccttgctaatattcctcatttaggggaagattacacctacattgatcaattttttctccccttggatcaacattgagaagttaaatgtacatcaacatttgtccgtgtgtgactttaaccatcttgaagagggagaaaggtcaggaaagcaacttttacaggccaatgtcgttttagcttgtcttctaccattgtgtaccatacaactttagttactgggctaataattctattcataagttccactaaaaaggtacaggtctttttctgttgtcgttgttgtttgaagtaaaagagctattatacaagttgtaatagttatacttgtgaggttaccccattttgatttaatagtttctccccttttaggagagacactgcagaatggaaactatcctggcaacagaatatacatggccaatttttcgagtgatggaaaacatccaactagttaactggcatgaaggagcgttgag

SEQ ID NO: 13557 - DNA, 1239 bp, Homo sapiens
aagttcttgatgaaattggaattgaaatttctggaaaggtatgaacatcatcttttcttagttggaaatagtttctgcctaccacgtttgtcacttaattgttttgtttttactaggaggtgcatggtttttatttctgtttcaaaagtaaattaaacagacctctttacagcacatcctgtatgtcctagtccaaatgtttcctaatgcacgtttgtctttttcattgtttaatatagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaa

SEQ ID NO: 13558 - DNA, 3499 bp, Homo sapiens
tttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaatcttactgagttatttttctactagttatagctcccttttataatactagtcattatactcaacgtaaaagtatataatctgtcaaatcagattcacatcatagctacagatatcccttttgctcccaagttgtatagatagatagtatttaagtttaatcattgcttctaattggaaatattttagttttttttacttttggaagtattagttattaaaggacctaatttataagtttctctgctatattctcattaccacttgtaacaaaaaatgc

SEQ ID NO: 13559 - DNA, 1957 bp, Homo sapiens
ggatagtgggcttgtcaaatgtgaaaattaaataaattagaagctaaaatgctatctattccagattattttcaagtttaagaaaaagagaaaggtatatatttaaaagagttaaacaaggctactaaatatggaaaattggacattggaatactatgtttattcagctttcattttaagagttgtgttttttaaagatagactagtataaccatttttttggaaaaaaagtatttagcactaatatttttctttttacaggttgaagaagaaggcttgcaaatttgtgttgaaatatgtggttgtgctctacaactcgaccttcatgatgatcccaaaactaaatgtctaatttataaaacaattgcacattttttgccaaatgatttggagatcctcaggatttgtgcactctcaatattttttctggagcgctccttagaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcagtacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaccttaatagacatagctatccaaatgtgtatttttgtttgcattttaattgcaacgagtcgtttaagctgccgttccagcttgcccagcacacaaaaagtcacaggatatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgc

SEQ ID NO: 13560 - DNA, 1212 bp, Homo sapiens
gttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaaca

SEQ ID NO: 13561 - DNA, 1405 bp, Homo sapiens
gtatagatattcaacacaagtgtgggtatgtgtgagtgtcaaaatttgtcaagaagcatatatagtgtcatatttcttatttaagatattttaattagttatcacaataatccttcaaggaaggtattttaacaataagtaaatctcaaaaccttttttgatgttcttctttatgaaatggccttttaagttacattactacgttagccttatactgaaatttaagtatagaccacctcagatttaaagagtaagttgaaaacaaataaacaaataaaaaggatctttcggcagacgccattatcctctgtttctctgctgcaccgacctcgacgccttgcctgtggcccacttgttcactgactataggctactgcagcactggggtgtcagttgttggtcccacccagaacgcttcagttctgctctgcaaggatatataataactgattggtgtgcccatttaataaaagaatatgtaaactgaacagccggaagaaaccttcccgaacactgaaaccaatggtgaatttggtaaacaccctgcagaagatatggaagagtaacaagcatttaaaagatctagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggtgctaaaatcaaagaacttcgagagaacactcaaaccaccatcaagcttttccaggaatgctgtccttattccactgacaagagttgttcttattggaggaaaacccgatagggttgtagagtgcataaagatcatccttgatcttatatatgagtctcccatcaaaggacgtgcacagccttatgatcccaatttttatgatgaaacctatgattatggtggttttacaattatgtttgatgaccgctgtggacgcccagtgggatttcccatgcggggaagaggtggttttgacagaatgcctcctggtcagggtgggcgtcccatgcctccatctagaagagattatgatgatatgagccctcgtcaaggaccacctccacctcctccaggacaaggtggtgagggtggtagcagagctcggaatcttcctcttc

SEQ ID NO: 13562 - DNA, 1166 bp, Homo sapiens
ccgtgttatcatttctgttcccattgctttaaatatccattttgtgtaggcaattcccaagtgtaaatcttcagtccttagtttctgccagaacttcagaccgacttaaagacatctccatgtgggggggggggggggggtcttagcattccaaacttaacattcctaatataaaactcttttttttgtcctgaaaacttgttttttagtaagtttttcccatctcgttacgtggaaaggggaactgattgcccaagtcaaaaacccaagagtattttttttaactccgctcctttacattgagtctgtcggcaagtcctgtctgtgctgcttctagagtgcatcccactcttctacctccctccttgcctttcttaccaccccagtcacttctcgcttgagctgctgcctgagaagcttcctcactagtctctctgacttccactcttttctacagtgcattcttcacacaataaccagggtgagctttcaaaaatgtaaattggattgtgtccttccctgcttaaaagccttccggactcccaattgcccaccttgtcagtcatccctttatctgttcacgtctgttacatggtgtttctgcactggaatggaagatttttgagaccatgggtattggctgtatcattgcataattcccagtatctggtgtataatagttgtgcagtaaagacttcctaagtgaacaagaacatgctcttattcttatttctaatacatttttcactcccccacgccgaccctttcttttttccttttttgtaaaggatgagctttggaggatccaggagaagctggaatgttactttggctccttggttggctcgaatgtgtacataactcccgcaggatctcagggcctgccgccccattatgatgatgtcgaggtaagagatggagaaaattgccccatgttgggaagaatgagttgttgagagcctggtttagtagagttgtcagggtgagttcacattattctctaaggctcttaggtctgtattcgctctttctgtgcagtttctgagatattgatttcatcaaaatgttgggccaaagtaaatcccactaaactggtttcctgctctgtctcaaaggaacagcttgtttccaaccttactaatttaaagagccacacattcgtctga

SEQ ID NO: 13563 - DNA, 1807 bp, Homo sapiens
aattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtatatagagtgtctgaattgatttaaatctcaacactttaggataaagaagtggaggcaatctctgtggttgtctgtgcaaagtgcatcttgctgtacagggctgtcgttacatcctgtgtttgggtctcttgtttgatcttctgggaaatgtaggaaccccttccccctattagaaataagaaaatctttatcttttatttttcagaattttaaaccatgttctcaaaagtagttttgttatctctacatgtcatacttaatgtggctagttttcagtaaagtcatttagtggctgtggatgtttgtgttctatagtaaataaccaagtcagcttctgacttagaacaaagtcagcattactctgtagccaattattgcctgtgaaatgactggttactcaggtttctatctaatcttaattcttgaagattcattaccct

SEQ ID NO: 13564 - DNA, 1289 bp, Homo sapiens
cagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagactaagaaatatttatattttttgttgccaggataatataggaaaacgcatatatttcttagtacagttgatccttgaacaacattagggctaggggccccaactcctccttactgcatgcagtttcaaatccttgtataac

SEQ ID NO: 13565 - DNA, 1378 bp, Homo sapiens
tggcctagcaagagaatggcttttcttgctttcacatgaagttttgaacccaatgtaatgcttatttgagtatgtggggaagaacaactattctctgcagataaatccagcatcaaccattaatccagaccatctttcatactactgtttcattggtcgttttattgccatggcactatttcatggaaagcttatagatactggtttctctttaccattctacaagcatatgttaagtaaaaaacttactattaaggatttggaatctattgatactgaattttataactcccttatctggataagagataacaacattgaagaatgtggcttagaactgtacttttctgttgacatggagagttggggaaaagttacttcacatgacctgaagttgggagtttccaatattctggtgactgaggagaacaaagatgaatatattggtttaatgacagaatggcatttttctcgaggagtacaagaacagaccaaagctttccttgatggttttaatggagttgttcctcatcagtggctacagtacttcaatgaaaaagaattagaggttacgttgtgtggcacacagcaggttgacttggcagattggcagagaaatactgtttatcaacattatacaagaaacagcaagcaaatcattcggttctggcagtttgtgaaagagacagacaatgaagtaagaatgctactattgcagttcgtcactggaacctgccgtttatctctaggaggatttgctgagctcatgggaagtaatgggcctcaaaagttttgcattgaaaaagttggcaaagatacttggttaccaagaagccatacatgttttaatctcttggatctaccaccatataagagttatgaacaactaaaggaaaaacttctttttgcaatagaagagacagagggatgtggacaagaatgaatgtggcttcttattttggaggatctcttgcattcaaataccccagccaagaaaaattgcacatagtgtatataagctgttcattctgtacagtgaattttctgaacctctcaaagtatgttttccattcttccacagcaatatgcaaaacatatttcatccttttctactttatttgttgtcctttgaaatgattgaccaggaaaaagatcatccttaaattttgaagcaagtgagagactttattaaaaatacatatgtatctatataagcatatgtgatagtggctctagttttatagagttgcaagtgtattaaacatgacagctgttcattcataaagatctggatttgctttaccttgttaatattatctaggcgaaaaagtgcaaattgctccatgttcttctctcccttgtgtaacatctcctgagg

SEQ ID NO: 13566 - DNA, 2962 bp, Homo sapiens
gtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaatgccagattcttctattttaacctcactaatttatggccaatattgtgcttccagcaacatttgaaaatgacactgttagtttactttgactttttctatgaccagcgccatcctttttttaaaaaaataatttcaacttttattttagattctaagggtacatgtgcagagtgcaggttgttacatgggtatattgtgtgatactgaggtttgtggtatgaatgatcccat

SEQ ID NO: 13567 - DNA, 1253 bp, Homo sapiens
tctcagccccaaactgatagcatacttttaccccaaagctaacagttttgtagcttgttttgcatctttttccctctgataggcaaatatgtttcctaacatttaacactaccatttgtttctttctcacatatccatactcaagttttgcatttattttcattcttttgacttgctggttcccatgaaatatgttagtattatttcctccttttctttagctatattctgaagaatagaggaaagaggattagggcttctactccttgtatgcccttgcctggtacactacttgcctggttacattactaatgtgttactcctgaaacatcagtctcttgacccagctatgactcagctttccaagtgaggtcatagttatgtgaccactgtcttcaggaaccaatattaatagccctcatttgttgagcttttagatcatacctaccaccatacttagtgctctacaagcatttcatcatttaatcttcacaacacattttgatgtgatatgatccattcttttcagataaagacatttagaaggctaaagtggcttgaccaaggtcacaccgctactaaagtaatgatacagggatttaaagcaatgtttacatatatagccttctacatatatagtcttacatatatagccttcttctacataaatagtcttgtcttctcctaatagtttgttcagaatctctcagaggtatgtttggtaaaggagtgttcagatttaactgagaagtttctgtttattttctagactgaatcttgaactgggaaagccaagactcatcctcttttttgtggatttgtggatttactgacagttttctggaaggtggcagcaacgtatcttgttctagtaaaattagaatatcatcaccatttcacttcaaacgaaagtcaagggttttgagggagcaggacctttaactgatacaagagtaccctgggtggtgtattgcaaactccaaccagctgttggcattgtgcgccattggccacataagtagatgagtagacttttatttccttccctctttcaaccaaaattctttctgagatgtaatttttattctcttggtttctgaaattttcttcatttgtgaaattctcttggtttcatttgtgaaaatagtagagttatgatcactgtgcctcaaaattggatgagagagttttacttcctaaccttgttctgtccaattacttttgtgactttcttttcattttttaatcaggaa

SEQ ID NO: 13568 - DNA, 1192 bp, Homo sapiens
catctgtgcttggcccaggggtgcatactagggtaaagaaaaattttgtaatagcaacagtggtttgggattttcagggtaccaaaaaaaaaaaaaggaaagttgctttttgtgtatgccaaataatgatactttactcttcatgaagtgctgacctagtacctagtgagtttacaagggaaaaaaacctgcttagttgtcagtttaacacagcctaatgtgttgttatctgtgactgtcataaccctagaacgataaccttcaggagtgtaggctgggaatcaggaaacccagcctctgatcccagctctgcctttaattagccagggtctgtgttgttgcttataaaatgagaatactgggataggttgtcccatgagatcactcaggctggaacaaggaccaaggattgtttcctttgacctctaccctgttcctcaccccctgatggatcccgtgatagcagggttaggacctgagactggatgatctttgaagtcccgggatttcccgctttagaattctgggactctctgttgtcttgtatctatggatacaaatacagtgcagttggcagtgagaagtagatcctgctttgttttcctatgtagttcctttagtcagttttacttgggcttaagttagttgaaatcatggtgtatcttggtaaggatgtgtccatgcaagaggactagaagagagtttgtaattatttacttaatttatttgcaggaaatggccaaatgtaaatagaagtctattctactcattaccttcctccagcagcccctcagccaattacttattataaaatttaaattttaaaaatcattctttattaatgttgtatattaaaaattactctacatagttaggtgctacttagacatactttttagtcttcattttcttactcatttttgttttagaattgtggatgtgactagaggatatttttgcttgtatcaagtaagtgaaaagcctcaaaaaagaaatcatttttggtcttggtcatttaatatggtatcgaggtagccaagcaaaactactccaatttagagaaagaaaataatagtaataatggtagctaacatgtattcattacttatcatatacaagcccattctaaatgccttcctttgattaactcatttattttgcagaggaaggaactgaagcttgaagccttttt

SEQ ID NO: 13569 - DNA, 1372 bp, Homo sapiens
attcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttgttcttaaagacactgtctctctctttcttttccctatttgcaaatctcttaaggtcacaaaattagagaattgaaggcatgtagtaagttacctactaccatgaactacacagttacaggattatttatgactattaaatgaaaatacatttcattgactgttctaggcacttgtgtagatcatcctcccttcactggcccactgaccacagagctgggaatcactctggggtggccacctctcatgggctcttgtgattgcaaaggttg

SEQ ID NO: 13570 - DNA, 2851 bp, Homo sapiens
tgtaatagtagttgacattcattgagtgctttcaatgtggtaggtactcttgtttattttaaaagaagcattttactagaatcatagtagaaacttagtggtcagacttcatgtagcatcacttacaaccttcattgaatattgtgaagaaacttagtggtcagacttcatgtaccatcacttacaaccttcattgaatattgtgaagtgcttgttgaatctgagacttaaaaattttgttcttttagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaagctcttctatctattctttaaatagaaagataggtagtttaggctgggcatggtggctcacacctgtaatcccagcactttagcaggccgaggcgggcagatcacgaggtcaggagatcgagaccatcctggctaacacggtgaaatccgtctctactaaaaatacaaaaaagtagccgggtgtggtggtgggcgcctgtggtcccagctacttgggaggctgaggcagaagaatcatttgaacccgggaggcggaggttgcagtgaacctgctgagatcacgccactgcactccagcctgggcaacagagcaagactccgtctcaaaaaaaaaaaaaaggtagttta

SEQ ID NO: 13571 - DNA, 1164 bp, Homo sapiens
atcatttatttaatttataaatgaaatatcctaggattttaaattctgattgtagaatcaatgaatttattccaaaagcatgcagaacactatgacagagccaaagaaatagcttattttaatgaacattcacattaaaaattctgtttccataaaggcagagcaatgtaaaaaaatgactttcatatgaggccttaagggtcagatagtttctgttttataggagattggaaagaaagcactgcaaatgaagctcctatttgttggatgggcttttctctcctaccaaggacaagaattttgaaggttcattttataaagttgtatggtggtgaatgccattgtttccacacaaacactcctttcccccataagacctcaaatgtttggttgtgcagggggatttaaaatcagagaacatgaagaaattaaaaatgaagcaattagttgtaggctttaacaattaacagaaaaaaaccaggggctagaaggcagtagcatatgagtttgagaaacactgctttacctcattctttctttcactgggcattagctagtcccacactcagcatagccttgattcagtcatttaacattttaaagtgcaagcttggtgcttgaataaataagcagctcctgggtagcgggaagagatggagactcaaagaggtcatctcagcatagtgtgggaggccatgctgcagcgaggggatgtgcaagcgctgtgggggcatagtgggaacagcctaaatcagactggaagttcaagatcaagagaagaatcacctccaagactagacctttgggttgtaactgctcccttgtgagtcttggagtcaaaacctcagatttctcaggccagcctttatttttacttttatttttgtgatagggtctcattctgtcacccaggatggagtgcagtggagtgatctagctcattgcaacctttgcctcccaggctcaagagattctcccacctcagcctcctgagtagttgggactacaggcacgtgccattatgcctaacttttgtatttttttgtacatatggggtttcattatgttgcccaggctggtctcaaactcctgagctcaagtgatccacatgcctcggtctcccaaagtgctgggggttatgggtgtgagccaccatgctaggcc

SEQ ID NO: 13572 - DNA, 1199 bp, Homo sapiens
atgcttgatattttgaaattatcaacctaaaagaatgtgtaggcaatttcacatcatttcaagttttaaacataaagataaaactttcatatcactttccttcagataggcctgaagggccactgtatggcgaagtatatactgtggatgtgaagaaatccttttcatttctgtgttaaaaataatggaacttttgcttaatatttgtgagatttgggcaagtggtctaacctctctaaatgaggatccctaaagaaaaaggggtaacagtgcttcattcatgggtatgttgcataaattaggttgaagactgaacataaaacacttgacacagtgcagagtacatggtaagtattcaacaaatgtgagtttttattttgtttttattggtattatgatattgtactggtatttactagtatgcacagtaatgtaggatcctcagaatcatcctcagtgatgtatccataataatcagaagacagtgtactttatggaaacaagtgatgttttgtccagattctggcaatgaaatgtcttttactttctgtgtgttcttatatttgtagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggtgagtggaccattctgtgttctatttttaccttttaggtgttttcattcttttaaagaattggttggagcttctgaaataattttatatcaattgttctgatctctgaaagaataaaccctatcaaaaaccattttgcaaatgatatgaaattaatcaagttattatggaaaagcttcagtaataaataatttctgataggctgtagaagactttagccttctgcactcatctttttttcttggttcctaaattggagaaagagattaggccagatgacttctaaggcctttccactgaatcttccatatgaagattcaatgaaaatgttctgtgttcttgagagttccactctagcctctccattataaaagataaaatttccagttttcccattagatttcttcatgctttattcatggcaacaggtctttgct

SEQ ID NO: 13573 - DNA, 1169 bp, Homo sapiens
tatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattctttttttttaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaatttgaaacacagtttttaataataattaaagaaaaactaattttttccccattgtataatgacatgtactgt

SEQ ID NO: 13574 - DNA, 1592 bp, Homo sapiens
aatttatgtcaaagtacttctataaactacttagtctaattctcccttttcaggtaaattgtgtgtaggaaatataaacatatattggtgactccatagcagtttatgagccttttgacattattaccataccatggataaattgtcaaggtgaataaggcaggtctattgatgcaatgatgatgctttcatccttagaacaagcacacactcagttttcagacttggtttcccaaaaagatttacataaataattatacttggtttgagagatggaatgctagaagtaaaggaatggtaatttttaattaataaaaaccaagccacattttcggaaaggtttgcacatacaaagttgttttatcttatgggagacatatcctgaagactttgcatgcttcacaacatacatcattcccctttagctgccgtcttgcatctccgcatgtgtgcgcctaatctcagctggtccacccaggaccctcttagcaccaaccctagttctctgcatggccccttatctgctctgataggatgaaagaaacaatcatgaatcaggaaaaacttgccaaactgcaggcacaagtgtgcattggtgggaaaggaactgctcgtagaaggaagaaggtggttcatagaacagccacagcagatgataaaaaacttcagttctccttaaagaagttaggggtaaacaatatctttggtattgaagaggtgcatatgtttacaaaccaaggaacagtgatccactttaacaaccctaaagttcaggcatctctggcagcaaacactttcaccattacaggccatgccgagacaaagcagctgacagaaatgctacccaacatcttaaaccagcttggtgtagacagtctgaacagtttaagcagactggctgaagctttgcccaaacaatccatggatggaaaagcaccacttgctactggggaggatgatgatgatgaagttcctgatcttgtggagaattttgatgaggcttccaagaatgaggcaaactgaattgagtcaacttctgaagataaaacttgaagaagttactgggagctgctattttatattatgactactttttaagaatttttgtttatggatctgataaaatctagatctctaatatttttaagcccaagccctttggacactgcagctcttttcaggttttgcttatacacaattcattctttgcagctaataaagccgaagaagcctgagaataaactttgaaacaaaggttaataaagttctttgcctagtaaaacaaaacaaaacaaaacaaaacaaaacaaaacaaaacaaaaagcttatatcattaaggccaggcgcagtggctcacacctgtagtcccagcactttgggagaccaaggcaggtggatcacttgagtgcaggagttcaagtacggcttaggcaacatggcgaaacaccatctctacaaaaaactaataaaagtaaaatttaaaaaatacttatattatttaaatctcacttttccataagaatgcttgtaaagtggtgggcacaggttctttgggataacaatcaataattttgttacatattattatttta

SEQ ID NO: 13575 - DNA, 1497 bp, Homo sapiens
tacctctctagtatgcagaggtgtgcagcctaaatgagaaggtattcaagaccctactagtgtctgacataataaatgtcaacttcattgacgcagttcttggtataaccaaaaaagcttgagatggccatgattatgtatgactagctcttctttaacatttttcttaacattatttctcctaacattatttcaaacagctacaaagatttaaccaaagggaggagaaaaaaaaactaccaattttaccctattatttaaagcaggtagttcaaataagtagcttctctcatagacagaaattaatgttggccgggcgcggtggctgacgcctgtaatcccagcacttcgggaggccgaggcgggcggatcacgaggtcaagagattgagaccattctagccaacatggtgaaatctcgtctctactaaaaatacaaaaattgctcctccacaggaggcctacacgccgccgcttgtgctgccgccatgtcgctagtgatccctgaaaagttccagcatattttgcgagtactcaacaccaacatcgatgggcagcggaaaatagcctttgccatcactgccattaagggtgtgggccgaagatatgctcatgtggtgttgaggaaagcagacactgacctcaccaagagggcgggagaactcactgatgatgaggtggaacgtgtgatcaccgttatgcagaatccacgccagtacaagatcccagactggttcttgaacagacagaaggatgtaaaggatggaaaatatagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgaaaaaaataaaaaataaaaaaaataaaaaataaaaatacaaaaattagctgggcgtggtggcccgcgcctgtagtcccagctacttgggaggctgaggcaggaaaatcacttgaatcggggagacggagtttgcagtgcgcccaggtcacgccactgcattccagcctggcgacagagctccatctcaaaaaaaaaaaaaaggaaaccattcataaaaaaaaaaaacttatacttccaacttagtagactgctcgacaggaattaaaattcagaatattctctagttaagcccctaagacaaacttgacagtgttttcaaaaaagtgactatctgccacaaaattaccaattttgcaatatccatggtatgacatattttaactatgattcctatgcacaatttcattaaaaatatctgacattcaaaaatggcttaaacttaacagcactactttcttgtaacggcaaggagacaaattatgtagaagttaagggatatttacttac

SEQ ID NO: 13576 - DNA, 1653 bp, Homo sapiens
actaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaatagtgtttttattttctattccatttaattgttgcttactggtttttgtttttaaagttgagacaaatgtcaagtgttgctcttgttcattttgttgaccaaagtaatgggggatttaaaattctgaattactagtgtctacctagctcagcacctagttctatagcattacagaatctcagactcaaaaagacttaatcctcctccagtgccaaaggattgtctgtccagttctttagaaaatcttgccaaagcttttctttgacaatcactaaatattagaaagtattcttttttttttttgagacagagtctcactctgttgcccaggctggagtgcagtggcacgatctcggctcactgcaacctctgcctcccgggttcaggcagttctcatgtctcagcctcccaagtagctgggactacaggtgcatgccaccatgcccagctaatttttgtatttttagtagagacagtgtttcaccatatggtcaggctag

SEQ ID NO: 13577 - DNA, 1183 bp, Homo sapiens
tgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttt

SEQ ID NO: 13578 - DNA, 1212 bp, Homo sapiens
acaaaaacagtgctagtcacaggagtactgtttcccagcctatgactctggagctgactggtggtttgttgttgttgttgcccctggccagatctctgatggtagcctatgtagcaaagttattttagggctagatggctcctttaaagctaatacagtccaacctccatctctgaatgaagaaacagaggcccatggttggttggactgctgttagtaaatttaaaagtcagtagtagaattctggtctctctgtgactgttacttccattaccccatggtctctgtgtaaaaagcaagtcatctttcccaaccgacttggcctttttctggtatccatgccttttcattgacctccttggttcttctttccgcagtcagttctaatgtaagatatgatacacctttccatctttggaaccccactatatacccttatttctacatgttctgtactttcctgggaaggggaagtagaaaagggaagaggttaatgttctttctggaatgtccatccacaatgtggtgattctattggagaggtaaacaagactcctgtaatcagaagggacagctgatggatctggataagaaattcgaaatctcgaagcttatgaatgtgcaatagatgttatttaatgctcattgtaaattcagattttgggcttctttatacttaaaggaggctttgaattttaaggctaaaatagaatcatgcatcttctttggagtgtttcttaccgaattattttttattttgctggaagcttttattgaagtttaaactaaaaaaaaaaaacttaaaatatgtaccaccactggcctatgttaagctaaatatcaaagtataaatattctaagactaagtataataactgagtaaattaatccaccattgaggtagatctatttgacctgggaatagatctgcaatctaaaaggagtatgttttctgacctttgattacttacttgaaaaggtgtttgggagcattgccaagtagttttttaaaacaactgttatcttaagcctgtctgcacacagccatctgttatgcaatattgaggtaaggccaaaccacaaatgatggtgtgatttctgctttacatactttcttttgatgtaattgaaattatttcccacttgtttaggaatgtgaagcctggaatcagcctttcttttgaaacatcttttaaagacaaggtgccatga

SEQ ID NO: 13579 - DNA, 1905 bp, Homo sapiens
atattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggaccttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaaactgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgt

SEQ ID NO: 13580 - DNA, 1101 bp, Homo sapiens
gttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaa

SEQ ID NO: 13581 - DNA, 1262 bp, Homo sapiens
agtactctatatctgaaatgacatttatttctcccagaaactctatgggcatagacactgttgttattcccgttttgtagataagaaacaggcacagatagattaggcaatttgcccgcaatcacccagccgtttcctgatagtactgggatttgaactagtactgtttaccactgcactgtactgcctccccgttttgcatttattttgaggattttatttccatgaagggtgaacctatatctaagcacataatactgagtagctaaaacttattaggagagcagaatgttgacctgatttgtttacttattctgcaaatacctagtgacagggtgcctactgattgctggacaccaagctacatgcctgaaatgtgggtgtgatgtgcatattgccctggttttgtagcacccacatttaagccagggagacacgaatgtatgtgcatcccatgccttgtcacatctttgagatagtcatggatccaaatctaacttttctgttagtgcctctgttgatggcctgagcattccaccaaatagaaatagaaagcacctctattctccacctgcttagatgtatattttttagaatccagtatggtaaatcttctaaagcattcataataactcagacccatgacttttattttatagatttctagttctgcttaacttttcctgattaccatttatggtctgtacttggctacaggggatttctctcagtggtttttccagctctgcatgtgagtctttgtggtccaagacaaacctggacctttaccaggctaaactttcagtaaagacagcaggttatgccctcatttgctcactctgaggagaaagagtttctttataccagagctgtatcttgaaagatgtctcaggatgccattggtcctactgaggaagaagcctgagaagactcttaaactcccagagcccagccagcacttggtgagccctggaccacgtttcaaagataaaggcctcttacagggaaatgttcctaaataccttcacctttagcttagctttaacttaggaacttttaagcagaatctctatgcttagcaaacagctcagagattgctagaatcaaacaccaaggcttaactgatagtattgaatttcagacgctttgtttgtgttctgaaaactacaccaactcacagtttgccactctactgacaattaagttcctggctgattttcaggattcttctttctcactctgatatcattttaagtgctgtc

SEQ ID NO: 13582 - DNA, 1134 bp, Homo sapiens
gcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctg

SEQ ID NO: 13583 - DNA, 1149 bp, Homo sapiens
gccatgttgttgctaaaggtcatttacttgaacaaaaccttggatgactgaaagacttctgtggtgattagtctttgttattacttttgcttgggaacatgttgtttttgtttaggttttttgacaggcagaaagcagcatgctaattgagcactggctgtggcaaagcactgtactatccttcattcttttggaatagtttttatcctacaggagcttaggatacaatgtgagagaccaaatagaaaatgagcattaatgtggaatgtcttgacttctcaaaatttattttcagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggtactaaatgattatttacttcagccaataaacttccattgattgaatgtctgctctgtgccaggcacagtgcaaagggcaagagattcagtgagctcatggttttgggaaaatggactcatcaggaaggtaatagaaattatagtgctagagatgtttccagaataccatgggaaatcctaggctaaagaagtccaaaaaagctttctggagagtatcatagttaaagaactatt

SEQ ID NO: 13584 - DNA, 2406 bp, Homo sapiens
agcaacagcaccacttgaaattgacatgctataaataccacatagtgtcctttgtccataattaatgacagccccctttcataaagcataagatttatcagtctcttcaggcttctatatttgcttttgaaagatactcaggcttgagttttgatgttagaaaaatgtgaggcatggtggctcacacctgtaatcccagcactttaggaggctgaggtgggtggatcatgaggtcaggagatcgagaccatcctggctaacactgtgaaaccccatctctactaaaaatacagaaacaaaattagccgggcgtggtggcgggtgcctgtagtcccagctactcaggaggctgaggcaggagaatggtgtgaacccaggaggtggtgcttgcagtgagccgagatcgggcccctgcactccagcctgggtgatagagtgagactccatctcaaaaaaagaaaaagaaaaatatgaggttggcatgtcttttgttgattcttggcatttatatagattaaattctggtgttactgccacacagttgctattggtatataattaatgatccaagtcctctgttgcagagatgtaatttgacacaggaaaaggtagtcatagtaaagaaaggcttttcagggaagtaaataatagccagttcagtcaagccatgtttgtaagacatcatttcaaagatatgatatgtggtacctggtacagaattatattttgtatttgctctaatatgaagatacatccacaaaatgcctaatcccaaaagttttctaggaaagatccttagccattgactttcccctttgaagtttataaggttctgacaatttaggaaatacatgtttaacaaaacttatcctactctttgccattgcccacaagtagaaagcatataattcattcaggtcattttttatgactatagttagtgggcctattatatatagtgcttattattaatcctctctcatctgacctggccctccattatttatatacgtaaaaatgatttgtttttggagagtcagcattcaagcaagtgacttaacagatagttcatagccgaaaattactgtcattatcgccaaagaaaacaatctgagaagtgtattcatgatctagggattttaactgcaaacaccataagcatttcataccaggtactagtgacttttgtatcattagttatgactttttctggattataaatgagaacagtatatagtaaaccaaagaatatagcaagtttctccaatttccttgtcaggaaggattgctagtcatcttgaaaattgaggttgaaggaagcatttctagtagaataaactggctaaaaggtattgtgcagttaccacctattttgtttagcaaaccacagggaaggtgccatggttgcagcaattggtttgacgatccacagcgtaaggctttaaagatccaccagaagacatgttggttggtaaccctgatgcatagagtgacaactgcctctgctaggctacatctgagagactgacataaatctttttgctccttagtgcattagaccatggttgatgcaacaggggacatgtccaacgtgcagactccacgttttgctaccagaagaattccctggtcaccccagccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggacaaatcttcaggacttgtgaaatgaactgaaagagcttgaagcagatggaattttaatagttacactatatatgctcttagtaggtttttttcttgtagtggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagtataataataataaaagaaaaaaaaaagaaagtaaaaaaaaaaaaagaagtggatattcacggagagctatgaggggataaaagggtatgatctaatggtaagaaactggaagaaacatagcaagtcatttgttcagattcttctctgtgtccctgtgtctccagagataaggatgtccttttcctccaggtatacagtgggtacctctagaatgagggtcttatgacctgcttccagggaaggtcagagaatccttcctaggtttt

SEQ ID NO: 13585 - DNA, 1157 bp, Homo sapiens
agagaaaataaaaaataatagtaactcattttctttttcctagaaaaatggggctacttggttacagtatgttttaatttgttgctttttaagtatatccattgtagatttttgccatatggttaccatgaggcttacaaaaaatattgtatagttgtttaacaggtttaaaaagtctctttcatcaagtgaaagacaagtagtatatgactactgttaaaaataaattatcaccaattccatttaattgtcactacctaaaaactttgaaaaaaatatgtgactggaataaatataaattcttctaattaagaatttgtttcatgtaactacagtggtggcagttttcggcattacacgcatgttcttgttctcatttgttgtatatgaacatttcactcatttttgtatattagtgtttctgaaattattaatacctaacatgatttctactttgaaatgacaaacctcagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaaggtaaagatatttactcacatatttccacatgctttgtttaactttctaagcagtgacaactcctgttgttttccctactgagttttaatgatactgaataaattcagtagagtgacattatgacttgtctcctaactatgctgatttagatatactatgggttaaatatcccttgtaatagaactggtaactgcctgttgttacatagtctggcagtatggtggacattagtcttctcttgaatgtaataaataatttttactgaattttctttcttttttccccaacaaaggctcttatgacattgtatggccttttaaaaactctgggttttttttggtttgttttagtcttggatactgaacttattgagggaaattgagttttacttgttttgttctgtgtagaatgttaacatttgtggacatggtatttgaggaatttaaatgtctgggtctcatttctcaaaggatggagacaaggagaggaaaaagttcatgattcagggtttttccaaatagagactgataa

SEQ ID NO: 13586 - DNA, 1164 bp, Homo sapiens
atctcttagcaaatacatctttcattggctgcagtagcagctagcaaggggcaggaagcaggatgtgaatgtgggtagggatgacgaccagccttgtttgcagcggggagccaaaggcaagcgaacctctattgggggaaagtcagaatgcacagtatgttctcaattgctgggctttttattcctcaaaatcagatttcttgacccagcacaactttgcagctatttatgaatcaaattcttaatgagccattgtggcattatacattattaaagttgtttctaagcttctgatttaaaaactttttagtagtaataagaaatacctattataatgaggttatgagagaagtggtgattaattataaataggctatctaccaaaaaataaaaacatgttctttgttatttaaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccaggtattattattgtttcttattcacaaaacaattcactcattctggaaatagcattcagtcaaggttttgcttcattttcacattttaagacactttaattataaaatatacattgcaatctgtgtttcctggacaaggtcccaatttctaatttttttttctgtattctctgttttgaaagagaagtcagattgctaatattaccactgtctggagagctcaaccaactgaagggtgcctgaagaatgcccaggtgggaaaaggcttttaaatttgtatttaagggagaaatattcatataggataaacctttaatctttaagttttgcattcaatgctttataggaaaaatgcttaactaaatcatacatattgttaccctgtaatcaaggttctgaaaaaactgggatataatgttaatgtattactaagtgttgagagtcatgttaacaaatgcacaactctagaattttcatgtgtccaaatgagtttacttctttgaaa

SEQ ID NO: 13587 - DNA, 1189 bp, Homo sapiens
agtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacagaaattgagagaaatgtagtcattttatatgtgaaaacatctgatttgagtttttgataaatactgctaaaacacagtatatgaacaa

SEQ ID NO: 13588 - DNA, 1229 bp, Homo sapiens
cagaaggaaaggtcaagacaagaggatatttttggcagagtttcttttcagttttatcaggcatatgttcaaatgccagttcattttgctgtgtccgttccccagttccccagagctgagtcgaggtttcttttgtttggttggcttaattctctgtatgtctcatatgttcatttcaagcttgagccttgcttaagagacttctgaggtttataaccctgttcttctccagtttaccttaactgatagcaactccaaattttaaaatgtgaaactgatcccagtccccattagtcacaattttgtatttaggagctactactattcttattcagggtattgtaagcgacaaatgactggaaaatataagttgttgaactttaccttgccattcaatagtttttggcataatgaatcagggacactaaactgtagtgaattctattcttgcctgtttttaccagtgctagaaaaatgcaaacagctgctctgctaatgtaagcaatgtttgaatttttagaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttcttttcttcattaagcgtttcttaaccaccagctgtgtttgtgaacttgactatagctttgtgtgtttctgtgatgatggtatttaactgctaacatttggcctacaatggcattttcatttaacagtacagcatctgcctgtgataactgcagtgattctccagaaagaaaggccccagctgatactattaacctcgttgggtctcaggcatgctagcctgttcatctgtaattcacacaggcataaaaatgagttcagaatctatttcactaattatttagctgggatttggatttccctgacatgcttaatacaattacaatacctgtgtacaaacagaggcctgaggaaagaggcaaaatttgctt

SEQ ID NO: 13589 - DNA, 1163 bp, Homo sapiens
acgtagtagagtattctggaattaaatgcagttttatggcgtggcgggactttccatctctcgttttgagaatcttgccatgagaaagtgcttcccaatgagacattactacctcccagctaggaggcttagcacaatgctaaaggtggagcaacagaagaaattcagatggaaatgaaactacttcttcctgggaagtaaaagagctacatgaaaccagtccatcctgcagatttagttcatgccacagttgaagtttgtgtgatgtttcttagtagctaatttcaaatttttactgttagattctaagaaacagagtgggctaatgattggagcacagccatgagactccgctccgttagctgagcatgtgatcctgtgctaaatctttcttggttccttcatctttgaagatgctgtctgctactttagtgctgactgatttgcaaatcttggttgattagctccccaatcataaggtccctaatgattagattaaatgccttatactcagggggtgtgcagatatgctattcttccttctgtggcttgggtggaaaagctgcttgggcttatttcccaacagtgtgatgtaggatggcagaacttatctaggaatggcacctttgatgatccatataatgaaatgtgtagagctcaaagaaatctgccaacatgtatgtggactcttgagaggtgggctttcccagtacatgctaaacagacttgttatgccaagaggaagtgaatagaaatgatagcatcaaatatccaaactgacaggaagtttcttttgcatagcatagaacatggttgtcttctgagttccactaatgttccaggatatcttggccctctgcctctggctgctccctggtgtttggcaccatagcgttgtcacttacaaccattgccttgggacacacagagtgaactgtttgagtgataagtaatttaggtagaaactttacccttaatttcaaatgataccaaacagctcattactaccccaagggacgctctccgtagcttctggattccccagtttccttctagaaacaaggactccaatagcactataaccctaaacaggccctaacccagaagaatacaccacaaaatgcgattgattttctcaaaatatcacagtcttagacactata

SEQ ID NO: 13590 - DNA, 1222 bp, Homo sapiens
gaggctgaggtgggacgatggcttgagcctgaggagtcgaggaagtccaggctgccgtaagctaggattgcaccactgcactctagcctgagtgacaaggtgagaccctgtctcaaaaaaaaaaaaaaaaaaaaaagaaagaaaataagggatgtgaaacttgtcaaacaaaaaataaatttaaaaacaaagccaaaaatctcacaagagagggctgaaactattgcgggtaaatctgaatgttgattgatactgtttagaatacatgataaagcagtaacaagaaaatgtttttcgattagtctctgtcttttgttgtcttgaaattcctaccgcattgtgtattttggaagaatcaagattggactttgctcaaagaagttactgatgttggcatgattttaaaactggagatctcatgcacagacttacttagtactttgagtctgttcttgttttttctattaaatggaaatagtatttaacatcaattcattgagataagaaagttaagatcgaaaatatatatggttttccaaagactgagtttacaaaccatagtttactttttgtgtactttgtttagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtaggaacaacacattactgagaaaatattgctactgttagcattacagtggagaattacttctgttctaatcagttgaagtaaatgccagcatttttatacattattttaatggtctgtaaacttgcatcttgtgatttagggtaattttaaaagcaacctttaaaagaccttttttaaaggcctttgtgccacgctgacaaccctggcagaaaaggacatcttaagggaaatattggtaactaagctctttagaggcaataatgtatgtgacaacaaacagatatactagttggctttcatacagtctcttatattatcattttccactggggacttaaggactttatttgatcactgtttatctaaaagtaatacatgtatttaaaagtatcataatgcaaatttctgctgagttttctcttccctctcctgtaatctgaatatgtata

SEQ ID NO: 13591 - DNA, 1178 bp, Homo sapiens
gaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgtatgtggagtcttatgagtcttcctagcaaatcttcaaatttgggggtggtggtgagggcctctccacagatacaaaactggtttatgtcctacggggcaattaaactacaatccatgggttatcttttatactggacaaaaattacaaacagcaaagataaatcatctatgagtgccacagtctctggtgctggagtgggttgatagaagatggcactggctattcaaggacttactttgcc

SEQ ID NO: 13592 - DNA, 1212 bp, Homo sapiens
atcataattactaagttcctagagaagtgatttctttcaaaaaagtaataaagtaagacatcctaatgcctgtgtattcctctgaagaaaaggaagtgtagctggatttattttagtagtctagacaatatcttcagaaagtctttctttatccaaattttgcagagttgccaaataaagtgtcttattgtcattctatatttcctcctataacagtgatcatctagttctacactgattgtacggtaaatggcttttaggtttttcttgcttttttcctcctataatcttttttaaggtataaagtacgtgattagttacacacacacattcggcatattcttatgtgcttgttttcctagccagtctgctgtaatagctttctttcattttctaattccctctactttcttctcaacgacgcagtctctgccaatatctaagataccctttcttcaaaatcacccccactttgtctcaccatatctggccatggtaaacctttccaccaaccctaatgttcactatccctgtgtatgtgcgtgcacgaacgcacacacacccctttcattgagttggaacccttccatgagacttcactaggtcttttcttgctcctcacttcataaaatgattctctggctccatcgctaatgattcttcccattacttaaccctcccatccttactcctgccccgcctcaccaaataaatcagccaaatgatcacttctaagtagagtgatctccttccttttgtgagaggacaatggaggaaatgtattcttgacattcccaatctgtaattctaaaatcattttcctgtagacaaataaactgactgggaacttaaaatcaccatttataaaaatctttcctttgataatatttgttctaagatccaaacaattgacttaactttaaaaattgcctatcttgccgggcacagtggctcatgcctgtaatcccagcactttggggaggccgaggctggccaatcacctgaggttgggagttcgagaccagcctgaccaacatggagaaaccccatttccactaaaaatacaaaattagccaggcgcggtggtgcattcctgtaattccagctaatcgggaggctgaggcaagagaatcgcttgaacccaggaggtggaggttgcggtgagctgagattgcaccattgcactccagcctggacaacaagagtgaaact

SEQ ID NO: 13593 - DNA, 1804 bp, Homo sapiens
aatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgcctggaggtagtgcgcctgtggctgtgtacatccagagggcaacagtaatagccaacaaccagacaaactagtgaagttaatctgtgagtgatgattttatgatacttatatgcaaattaaaggcagaagttagtttcttctcaagatgcctttttggctgaacattaccatttttctttccccagggtttgaaagaaaagggccttttttggatttaactatattctgtctgcattctattcttcatgcgtaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaa

SEQ ID NO: 13594 - DNA, 1767 bp, Homo sapiens
ctgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcatt

SEQ ID NO: 13595 - DNA, 1159 bp, Homo sapiens
tggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctcc

SEQ ID NO: 13596 - DNA, 1809 bp, Homo sapiens
ccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaat

SEQ ID NO: 13597 - DNA, 1061 bp, Homo sapiens
ccaagatcgtgccactgcactccagcctgggtgacagagcaagactctgcctccaaaaaaaaaaaagtaacttaacatacgtaatgaaaattattttccaaatgcgagttgaatttgtaatgtcttctttcaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcg

SEQ ID NO: 13598 - DNA, 1907 bp, Homo sapiens
gttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaacatttttttctttttctcttttttatggcacaatctgctagaaaatatgtaccttgtatcttgacttaatgttttggtatgaccttttaaaattttttccttccttttttatagattgttacttaagattatgaaattgaattggagccctcattatagcctgcaaaaagtcccataactgtatcacactatgttttggaaatataatctacagaatcccatcccattctgaattttactttgagaaagtgaatggtttctataaattcacttctaagtgcaaggaaatcagtggtactcttcagtttttaacaagtaaactaaagccttgtaatttatgattttgcaagccaatttaaagtccaatataacaatgtgc

SEQ ID NO: 13599 - DNA, 1951 bp, Homo sapiens
aaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagac

SEQ ID NO: 13600 - DNA, 1267 bp, Homo sapiens
ctttgttaacttttttttttcttttttgagatggagtctcgctctgttgcccaggctggagtgcagtggtgcgatcttggctcaccacaacctctgccccctgggttcaagcgattctcctgcctcagcctcccgagtagctgggactacaggcacgcgccaccatgcctggctaatttttgtatttttagtacagacggggtttcgccatattggccaggctggtcttgaactcctgacctcgtgatccgcctgccccggcctcccaaaatgctgggattacaggcatgagccaccacacccggccctttgttaacttttaaccatattgccattttaagcaggtgcacagcactgaacatttgccagtgatgttattaaccactggtaactttaccagcagaatagatagctgaggttgtggatttcttgtattccgtactttctggaatgtcactgtgacttctttcttaggtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaat

SEQ ID NO: 13601 - DNA, 1140 bp, Homo sapiens
atatgatgtagaagtctttgccttggcctcctccacaaagccccttgcttgtgcacattttagtgtggcagagggcagtaggatgtgctcctttcaaaaacacatagccttgtccatattggaattacttttcagcctgattatgcttctccatccctgggtgaaacctagatcaggctaaccaaagaggaaggctatgcatgtggtaaagtcctttaagatgacagatagggaacagtgcaataaacactgaaaaccagtgaagtgaaaggtttattttgaaacaagctaggccaacttggacattggaggatggattagaacatactagctgctccatcatagactatccttactaagcagaagaccttaatagtgcctaaaagtttagttttgaaattggttttttcctaacttttctttgttaaatttatttttattatcttttttaatcttagaagtaatcagagtttgacagctctttagtaactgttaataaaagaatctttcatcacaggataagcaatagattgtgtgggaaataataacacaagagtaaagatgctgaaggactcttctggaactcaaagtgacagttttgaaggttctggcacagtaggaaaggatcacaacccatataaatggctaatgttgaatttctctgaacactgtcacatatggggcatcaatttggaaaattctcaattgaggccccttccctaagattacaacattgataacctgtctttttctctctcttctttactatccgtccaagtctactattccaagtttaaatattgttcagaaagttgtcagccttgttagtcagaaaaactccatttagagccatccaaactagcataagaaattccttaagcactcaaagcattatctctgttttaagtaagaaactaaatccagagcttttaacaggtacttagaaataagtattgggtaatcactaagaggacattgactgcaccaaaccaaagctatagaaagaaatgattgactttttaaaatatattcacattaactgtcctaggatacttctcttgaggctttggaaaacttcttccttgaaatttgcatatccactccagttctgtcaccaaagattttaatcttcagatcgca

SEQ ID NO: 13602 - DNA, 1181 bp, Homo sapiens
atttattattgcttatgagcctcctgtctttccaagctgacacctgtcaggagcatcaatagccctaacagtaactaatgcatcaaaataatagacagaaacactatagtatatattcgtgaggataggaagatttttttttcttcttttctccaggaaaagcttgctttgctcccctctccctctgcaacacacacacatacaatgcatttcagaaagtctgcatcttattttacagatatgtagctctagaatttacaaatatagcttaggaaatgttctgagattgaggctggtagcaaacaagtttattttctgcactggacttcaggataagtgtgcatagatgcaattccttcaaagaaagtgaaacatggtagagcaaagggataatactttcacacattcaaacagttgtttgctatctataaaccttgatttaagcataattattactttttagaaatctgaaactggaggaatgtgtattttagtaaggtttttttgttgatttatttgtttccctttctttcttctcaagatagtaaaggatttttatttcttaatttgttactgtccatggacagtcaaataactgctcacccttactgtattattttccccttagaaagaaaagccttccatcctaccatgaaggaatttttcctccaaaaaatcttatcttccatttcaaatagcactcatgagcttttaagagagaaattctctctttactttgaggatagaacagttaaaacaaaaacctgttccttgagaaagaaaccgtatttacctaaactaacaggtctggggccaaagaatagatttttttattgattgcagatgaagaccatgcattttgtactacaaatccttattgcctcctcaaatcctttttggaataaggctgggaataaattagtttaattaaattctttgggtatttctaattaatatctactgcaagatacccaggaaagaaaaggaaggggtgctgccgaaatgccaaaatcaattgatctgttgatttttatcattgtagttgttgcttttctagccatttcaagactgtatgtgttcatgaagtcttaagtagagaaacacctgtttccccattgcttctctctccttccccacacccctgcacctgccccaaccccaggcactagagggaacagtaa

SEQ ID NO: 13603 - DNA, 1191 bp, Homo sapiens
gaataaaaggcaactaaagttatatttgaaagagaggaaggatattttcttcatattttttttaatttttcttaatttttattattttaagtattgcctgggttgatgagggcctctgtggccagcccatccctgctgtaatttgaattgctgctttgtattttgatatgtagttctttgactttagcaagcttaagttgccccactgaataattttttcaactgattcatctagaattctgttctttttcatggaagagactttatctttcagaaagagattgcttgcttctccaaaatttcattgagatcttacaattctagaatttctattgactttactttttttcttagtgaaacactaatagtctagaagtcttgataaatggggtcttttcttttgtgatcagccaggaagaggagttcacaaaactctgccatagctcctcacccttcccaactacaaagagcatcattatgagaagcctgttatagatcaagatgcattgatgccaaaattacttttttccttccaaatatcaccttctgactgtttccaccatggttaagagggctgaataagatgatcattctttagatgacgaattaacccttgcttcttcgaaaggttttagggaaattaacaaaaaaattcccagatgccaacagccaccattcaaaagaccaccaatctattgcatcataccagatgccactctctcttcctagtagggatttctctcctcggtcctgatcaaggtgttataatagagacattttcattatagacagtgtcctgaagggattccagctcaaatataggaattcttaaacctagctgaaactcccaaagtgatttcattgctgggcatattttaacatacttaggggaaagcaaatctttaaacaaagcaaaacaccaaactacagttttaaaaagaagaaaggagagcgtattttagtttcaaaattacattacattttaatttaattttccttctaattttcctgtcagcattttatttacaaaaactgtgcagcaaacgagggaaaatcttccaacacaaacaactctgtaatgactaaattggttttattcatatattttagacatttggttaacttggatctttttcataagttctttgtgatgctttgtaaggttagtgtaactgaagtgtttgtgagttt

SEQ ID NO: 13604 - DNA, 1099 bp, Homo sapiens
ttgtaaatacattagaatagccccagttttacttttattcattcattttatttcccttacccgtagtgttgaaatggaatttatcaatgctttagcattataagattttcaaataatttaaaagaaaaattatcttcactttaagcattgaatgcatcacttttttccataaacccgaaactcagaacctgtaggaacgccttcatttgctttatttctgacattaaatttgcaaaaaggcactttccaggtaacccatcagctatgtcaccctgggtatttggccagagggcagtcatgttgaccccatctgcaaaggctggctaaactagagtcttggactattagaatctcattcatcaaggtccacataaagtacggtaggtgggaagcaggaggacagatggtagggtcgggcgcaaggaacttgtttgttgacattgatgtagacgcttcttcttgccagagtgactccatgcacttattttggcatggaagactaggccaaagctatcatcttaatagaaggtgagctgcaggcaaactagagagatccatgcacagtaggtatttagagttggcttagattttatctatcagcttgactgtcatacatacttgattgatgtgcagcagggcttgaaagtgctgcattgatgttgaggactgtgtcataaggttcctgatatggtgcacatgtctgaatggagttggacattggctgtctttgcccatgccaaacaacaccagacttcagtgcattattctgcagttgagtagcagatggtgactgcagacgtttggagggggtgtgccttcaaacacaatatggagccagcaaacttacttagaaggttattacatgtcttgactttggcagctattttttaagcactgttgaaaatccaagttccatccattgttattcgcaaaatactaggcaaggttggtattccatggaaaagaaatgtgaaaacgcaaatacactgttcactatgctggttacagttacttgggggtgttttccttggtattgtctaaatgggccaagtaaacattctcagattgattattcctgaaattggtaccaaaacaatta

SEQ ID NO: 13605 - DNA, 1109 bp, Homo sapiens
atgtggtttttacagaatattcgatgcattatggccaaagaagatatggtctctgtcgtaaagatttaagattaggataaattattttacaagagaaaacagaagaagtttagacaaaagaaagctgattgaagcagagaaactattggaactataagattagtcaaggaaattaacaaaaagtagattttaaggaagctagagtctttggtgacatttagaaaaaaagtgaaatgattcattgaataaaataattactgatcagagtgcagcaatgtatccattgtcaaatgtcataaagcttcaattaaaaacacagaaataagcaaaatatacttttaagaaggcaaatgagatttgatgaaatccaagaacttcacatattagatagccctgcagggtatcagtgattaaattcattttatggataaggaaacagattcagggacgttaagtgatgagcacaaaaacacagtcaggattcaaaccaggtctgtctgactccaaagctgctttctcttttcattaccctatgcaatcttttgcagccaatttaaagccacagaaaacataccaaagaaacaaagacaaaaactatacaaatgtactggagaagaggaggcgggaaaacagaaagtgttttttctagaggcagactcactgatggcaatgagaactgaaatagaagtgagtaccttggctaaacaactaggaaaaaacacacaaaagaatcatgaaagtatttatataacttccctgttagcctctattatctttgatagtagtgtaatattttatttggattatcttttattattaaggctcttatcattttctagttgttagtatacaaagtattttgacacatattatgtcattttccactcacagaaaacttatattgcaagaaaggaagtattgctattcctgttttacagatgggagaactgaggcttgggtgggctaaatgatgtgtcaaaactttattaataataagtaacagaaagaacttaagaatctggaactactcactccagtacatttctaccatatcaagtcacttatttgtttcagaaaataggaactcattgtaaagattttcatcttaa

SEQ ID NO: 13606 - DNA, 1118 bp, Homo sapiens
gcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactgtaagtaggaaagtaatttaggcttttgaatcacagccttgtcatttgtgaaatgacttcccttgactctgaaattctctgtccaaaatataagctaggatttccagtaataacaatttatatgtataagatgattgatagtttgcagagtgtctttatatattttattttatataattctgactacagttttgtgaggagagaaccattattattatcttttttttttcagaaaaggatactatagctcagtgaggtgaattgatttactccatcacataagtagtaactgcccgaacctgaactttaaattcagttttccccaccaagaggtgatggttttctctagtagggagaaagtttctttcttaaaaccttaatttctttattaattttaaaagttttttttattttttatgtgagtatatatgtttatgctttgggtaggagtcttcttatgctgaattgagtttggggtggaattttgtgctcttagtttttgtcagtgaagaagtctcctacaatttctaattaaagaaagataagaaggaatgtattacttttctagtgtagaattttggtatcattgtgaacctccctgctaaatttgtttgtatttttccatggtaaatccattcttccagaaagctaatatacctattaaatagtattgtttataattaggaaatggtaggtatacagtagactccctcttaggttattcctgcttctggccaacagaatactctgaaaaaatggtgtgtttctgttcatctgtttacctgctgccatgcttatctacagtcatttgtgtttgtttttg

SEQ ID NO: 13607 - DNA, 1161 bp, Homo sapiens
aggatttaattcaacagtttatgtgaagaaattttataacttatgtgatagagaagtatcaattattgatgtgaatcattagtagttagaagagatctataatacaaaccaggaacagtagcacacacatgtagttccagccactctgcagaggctgaggtgggaggattgcttgagcacaggagtttgagtctgcagttaagttattaccacacaactgcactctagcctgggcaacagagtgagactccatctctaaaaaataaaaattaaaaaagagatctacaatacaacaaaatttgagaatttctggtttgggaagaaaggtagaaattggattactatgtaatgaatatttcctaagggttaaacactttatatatgttctcatttaatacttttgccttctctttgctatgaggaaactgaaattctggaaaaatagtaacttgtttaaggtcacaggtagtgaatgtggaagcttctttcaaatccaggctttgactttaaaagccacgttctttctaccgaagcactctgcttcccatacacctagagatagagtgtatggcccatgaataattaagagtaagatgaaaagctaatctttcagtttctcattgagacacagtgatgccttgcatttattattcctccttttactatatttaaacatttcacaataatttatttatcttttaaaaaaataagagcactatgaatttgacaggaaaacttgtgagatatcagatggattacataactaaatattgtatatcacaagctagtttttctctacctctggtttcttaactgaaaaaaaaaagagttgtggagaacgttaatggattgtaatacacaaaggaataaaataatttattaaaaataaaaattcctaattttgaagcagatgacatattttatatttctgttgattgttttttaataatacctaggcaaacttgatttcagatttattgatgagaattccctgctttatacagaaaatattcctgtagaaaccaacatttagataatctgataaggtctgggaaaaggtgagttctatgtagctggagtaatcaaagtggtataggttacacagaagtgttaaggaaaaagataagagaaactaatttgtgttaaaattaaacttttttc

SEQ ID NO: 13608 - DNA, 1169 bp, Homo sapiens
gggggaatagatggaatagaatatatatagtttttttcttgccacaattccctaaacaatacagtgtaacaacgatttattaatacatggcatttacttgtattaggtgttataagtaacctagagatgatttaaagtatgtgggagaatgtgattaggttaaatgcaaatactacactattttatgtaagggacttgagcatctgtggattttggtttcctagagaggtcccagaaccaatctcccatggatactgagggtcaactgtaagtttgtccagtcaagatgtggctactttttgcttttttgctttaaaatgaagaatctgtatttttctagtgaaagaaaaaaaattacattgattttcatgcctttgttctttgtgattcttagaatatatcaaagttgttgcacacatagtgcatggtgatatccctgtgccatctttccagtagtctcccaggaaagcttttgaaattgcccttgaggaattgctgatgtaactgttcagtactcaaggcttaattttcaagattggggttttgatttttatggagctcaattttggagggccttaggtttggggacacatggtgttgaagtaaacaggtgagaagaagaaaagtgagatttctagaactatattagctgctcagtgagttgggcaattggatatttttggttttatgatttcagattttatagaccagtggaatacaggccttgtgcatatgaagatcaggtgacaagtttgctgcctaccagcctccacagcaatatgccctttcacggtgaggtcctaattttaacaagctaaagaaagtatcaggttaaaaattgtcaaattttatccatttccaggaagaagtctttatgcttacccatctaggcccgtgttttaagattactacaaaaccaagaaaatgcacatataggtcatgtgtacattgactagctactaaaagaaaatacgagattaaatggaatactagaggaaagagaaactttcatgtgagggctataattggggaagggggtgtttagaactaccagttgatgtgatgccagtttcttctataattggatcagaaagtttttgaggcccgcaaacatctaattcctcttgttgtcctgttaataagaatttgactacttggtataggaagaa

SEQ ID NO: 13609 - DNA, 1174 bp, Homo sapiens
ggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaattta

SEQ ID NO: 13610 - DNA, 1100 bp, Homo sapiens
gcagaggttgcagtgagccaagattgtgccactgcactccagcctgggcaacagcaacagagcgagactttgtctcgaaaaaaaaaaattaaaaataaataaataaataaaacactggttaagttgttaaaatataggttgcttgactcaagattttattccttaccccttgagaggaaagttgttaggagtttacatgtccaattagtagcccaggtcattctgatggaacaaaataatgtgatccgtggaacatactttgagaagctccaatgttaataaattagatgatataaaaagaccttaaaagagttctgtagatggcactctcggggtgcaagaaggaaacaactgtgcctggagaagtctgaattttcaattattacgaagataaggtgggatggggcagtttttcttttatttcactttttaaagacacattttagcttccactaaacctattaagttcttacttgaattacaatgcttttgaagaagatcatttacaaaatgttcattttggtgcttccaaactttcaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtgagtactccagttttaccatgttattagtaaatctttagaaattatttcggtcacgtaaacgatacttttaagagtgaaaaatgaaattcttcaaatataaatgaagcatttagaaaactgggaaatccatgagcatggtgaacatataatttgttttctaaactggagtacagttgggacaacaggcataaaccaggactgtcctgggaaacctggaatgtagggtgtgttgccagtggagaatattttaattgtctctcttcaccaagtaaaggcccctcttgctatctatatttgggtaaacggtagttaattttagatgaatgcactggttcgaaaaccagtcttacccttggttggtcatattactttgatcttctgtttcctgtaacagaagtacaa

SEQ ID NO: 13611 - DNA, 1235 bp, Homo sapiens
gagcttttgtggtattcgctttgtaaccacagcatctgtctagttcttagcaaacaataagcgcagggttggatgctgacgcatgacttcatgacttgggctccctcacttagcagtaacgtgaccctaggtgacacctcctaatctacactcatctgtaaaatggcggtgataacttgtacatggttactacatggagtccaagagacagcaagaaggatcagtagcatggtgcccgcacctagcagccgctagctgactgaggccgaaagaggaaatgctttggccaacactggccggaaggggcgggaccgcgagttaagaggagaaggcgcgccccactgcgcaggtgcaaatggtaggggttgtcgtgccggctgattccggggacgcactcgcggctggggcagaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcgtgagtattactgagctgccccaaggtccggctgtcctggacctgcctcggccctcttgggtgtgcggcggagactgctttgtctacctttctgccgacttctcttagggaccagtctgttgaagtttgtggtctcctgcagtccaccacaccgcatactctcacctcttccgtcccagttttttccctgcacttttctttccctttgcttgttaatggagcaaggaccagcagcccctgcatccagcggtttgaatgctttgtttgacttggggttagtttacagccgaaggctgttaggaatagggagcatttgaaaacacgggttttttccagtgtcatccttgggttttagttgtattgtttaggaaacattggtatccatgttgacagaatcatgatttttgccgtagaatgatgaaaagagcttttttttttttttccagtgaggatctttatcttttacttgcttcttaatcttgcagtttcagtaattt

SEQ ID NO: 13612 - DNA, 1642 bp, Homo sapiens
gtgcctgtaatcccagctactcgggaggctgaggcaggagaatcacttgaacccgggaggcggaggttgcagtgagccaagatcgcaccattgcgctccagcatgagcaacaagagcgaaactccgtctcaaaaaataaataaataaataaataaataaaggaaaaagattgttaagttgtattgctacatgcatgtatgtggatatgattgccatagggttggttcttgaggctcaaatgaattaatttatataaaatgctgaataatgcttggcacaaggtgagcactcaaatgcagactgctattatcattaaattctgtgctttaacattttcttgttaaatcttgtctctaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacct

SEQ ID NO: 13613 - DNA, 1173 bp, Homo sapiens
atgtgattttgaggaagtttcttaagctctgagcttaaaaggcttatttacttaaaaaagagaacaatatacttacttcttaatttttttgtgatgtctcagtaatgactggtaaagattccaaggatccctatatgagtctgctgcctttattagcgttatcttgccaagggttatacataaagaaaggcacattgttgggtggggtttggagttttggggcatgcatcatcatattttttggctctccctttccatcaaaaatacttggagacagagtttagttatttattcctgctggggcctttgctttggttatgctaacccccatcccttatccgactcttccccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtgagtctgtaagcgcacgccctgctcaaacacggttgaatctgtgcgtgtacatccacctgcacatatatgtcttgtattcagagatcacagcaaccctcatggttttcacccccagccccctttctacccatctgctaaggatttcaagttcccttccagtaatgattctacaaagtagccaagtggatacctcaatgaatagggcagctgtggtgtttccctcttacacggaatcctgtcatttttgtggctatcctattctgccatgaattttcatgcctatttcctactttcctggaatttgctttttcagtgttgtcttggtatacaaataatattttgaaatccttggttaaaattccagagatacgtttttccactagctaactaataagtggtaaggccacatcttccccttctcgtgagttcacttcacattgtctttcttagaataaa

SEQ ID NO: 13614 - DNA, 1149 bp, Homo sapiens
tcactttatttttttcaattgactctagattttttcctttctacaggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagata

SEQ ID NO: 13615 - DNA, 1136 bp, Homo sapiens
ccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaattcacaagtgtgtggtctttatttcagtacccaaccctcttccttcaccctactattttgccgctgcaatatgtagtcacatcaccatttccattcctctaattagggaaacattaatctttgttatacagaacaagatatcaataccacttcttgttctttccaatgattttattccattgtgtagccccaagaggtgcagcttccaccttggaaacctttgg

SEQ ID NO: 13616 - DNA, 1199 bp, Homo sapiens
ccactgtgaataagtttgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctga

SEQ ID NO: 13617 - DNA, 1187 bp, Homo sapiens
ttcttttctttctttttttttttttttgagatggagtttcgctctgcattcactttttctaaaacttagcaactgagctcttttcatggagttgatgctcagttttttttttcactgcatcttagaaaacaataaggtcaagctatttgtggtaaagtaacagttcttacagttttgaattcatgggagactgttgtttttgtgaaatatacaaatgaattgctagaaagatgaaatttttaaaaatataaaatatggatcctaattcttattaccatattcttagatatcaatttattctctcattgttataaaagctctaaacactctcaatttctgtatttgtcttattggagagcagtaacagatagttcatggactagtaacaaatattttgcagatcagaaccagtctacagatcacactttttagtagcatatctatagcttgctaattttagtgcttaatgttatttcagaagcatcttgttcaatatgatgaatagctgttatcctttaaaaatatatttttatgtgtttccttttcagaatcgagagctccagatcatgagaaagctagatcactgtaacatagtccgattgcgttatttcttctactccagtggtgagaaggtaggtttgacacaaagtgtgtactgaatattgtgataaatttgttatttttctagaaattaatctccccaccgctcatagacagttttgctaatggaatggaaaaattccgaaacacttgccccagcaatactcagcccaaggtatggtcattgatatcattagttatatcaggaaagcattagtaagataaagggaatgcacttttaagaattttcttctttgttaaagtatgtcttcacttctcaagaaaatctatatactttttttttttttaaagacatctatgttccttatgtgcttacgcagccctctgatagtttacctatttattgcagggaggaaaattaagtcattttgttaagtgaagttgataagaggtaaagaggtagcaagaggactgataggaacagaatgagagttaaacatttggaagcaagttgagccatccttggccagtgaaaaagttggaaaagatgtaatattgcagagcttactttaagtgatccctatgtctgaccacattgaattctgcgaaaccaaaggataaagaag

SEQ ID NO: 13618 - DNA, 1257 bp, Homo sapiens
attgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactaccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttggg

SEQ ID NO: 13619 - DNA, 1825 bp, Homo sapiens
aatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtggatttgagtttcaggagccttaaaaaggactgaagagtttctcctgggactacagcttggatggaaagtttactcggggactggtagaacaagtttctttgaaaggatcatggatagtgggtctggagtagaaggtgatgacaagtcagaaagtgtcttagtcccttcaagttgctataacaaaatgcctcagactgggtaattataggcaacagaaatgtattgctcacagttctgaaggctgggaagcctaagatcaaggtaccagcagattcagtgtctgatgacggcttgttgaagcttgcctgcttcaaagaatgcacctttttgatgcatccccacatggtgaaaagggtga

SEQ ID NO: 13620 - DNA, 1177 bp, Homo sapiens
gaaatcagtttgggatatgtgacgttttagatgcctgttagaccgtatgtcagagttcagcagttggttggatattaagtctggagagttacagggctggaggtaaaattttgggaatcatcagcctttagatagattatttaaagttatctgaccagatgacatcatcaagggagtaaatgtagataggaaagaccagcgaggtccaatattaagagattggggagatgaggaggaaaagagcaaagaaatgaagagagaatggccatagagttagcaggaaatccaagcaggtgtgggcctggaagtcaagtgaagacatgattttcaggagttttcaccatgtcagatgctactgagagtgcactggacttttagtgatgtcagaggaggaaaactctcttcatagtgtgtcttttggaacctctcaataacattaccgggcttaatgaactatggtcatggggcaattggtatttttatgaaatgaaatgtctgtttctggaagacagatctggcagatattaaagcacagagaggtgactagcaaattgagaagtctgccatttgatagtcattcagatacatttatagtagaaaggatgtaagaatagatgcattaatcctttcagctattgagctttaacatccccttggacctaatctgtgtctttaccctcttttttcttgttggcagtataggcataataataaacaatgctgcagaacacttgcatgtgctttcattttaatgtggtgtgataatgtcaatagtttctagaacagcagaagatattttgggactttgtatctagtagtgagtgcttacaccgttgaggaatttcagtctgattaaaaggaacggaagcatttccatcataaggtttttttttttgtttttttttttttttaaacttctgagctgcagctgattatctcagggtaaattgttgtaatttagtttgaaatatgactgtggaagaccttgtgaaattattttagtcctacaaatcatgacttcttgatgttggttaggaccttgaatattcatgttatatattaaagtcttaaagctgattttatttgcttatttttatctgtcagttaattggagagactaattttgtaaaatcacttgggcatttagctaattaaatttatgtgtttgtgggtagat

SEQ ID NO: 13621 - DNA, 1212 bp, Homo sapiens
ccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaat

SEQ ID NO: 13622 - DNA, 1775 bp, Homo sapiens
gcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgttaatttttaaaatgtagttaattttttaaactattttttgtaagtgtgttcatgtatatgtagaattcgtgttatgggaaaatgtcacaagtgaatatggaggtaagaataaaggtattcattgcagcagtatttgaaatagaatagaaagatagatatactcactaaatctgtatttagtcctaagtactcaggaggccaaggcaggaagattgtttgagccaggagttcaaggctagcct

SEQ ID NO: 13623 - DNA, 1175 bp, Homo sapiens
aaattgtgagaaggtaaatatatggggcaaactaatggaagatagaagttattttagtaggtagagtttgtttgtgcagacccatctcagtgctgacctgtctccagtgataagggttgttgtcctgtgtgggagagggaatggaaaacatcatcacaaagggaaaaatttattcttgcttttaggcagatagggagaggacaaagagttctttctgtgtttgctgcttcccaatggccttcagctcaaaataatccttatgctgaagtggcatattttggagtggcatattctgatccccttctgtccaaagttcaaaaaatagccataattttattaccataacaaccactatcatctcttgtctgcttttaagcaaagtaaggcaacttaaaatctctttagcagatatcttatggaactatattgggattttgcaaatgtgtatcttttggttataggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggaggtaagagagaatttactaaattaccatttgctcttttatgcctaaattagtaaaatgttagtatatgaaaatcttagctttatttatttattttttttaatttatttttgagacagagtctcactctgttacccaggccggagtacaatggcatgatctcagctcactgcaacctccgcctcccgggttcaagcaattctcctgccccagcctcccgagtagctgggattacaggcacacaccatcatccctggctaatttttgtacttttaatagagatgggatttcaccattttggccaggctggtcttgaaccagccttcaggtgatctgcctgccttggcctcccaaagtgctgggattacaggtgttagccactgtgcccggtgctttatgttttttttgttttgtttttgagatggagtctcgctgtgttatccaaaatttcagatgaatttaatgattcatttctttttctttctttgtttttgagatgaagtctcgctctgttgccaggctggagtgcagtggtgcaatctcagctcactgcaacctctggctcctgggttca

SEQ ID NO: 13624 - DNA, 1408 bp, Homo sapiens
ctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactg

SEQ ID NO: 13625 - DNA, 1161 bp, Homo sapiens
caaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattg

SEQ ID NO: 13626 - DNA, 1197 bp, Homo sapiens
acttcagtgcaggattggcagagtgcccttggaggtccagctgggagatacaaactgattttaaaaggatttagcagtgttatggtacaaagaaggttttgaccaaaaagtctgaagttttagaagatgaaatacaagtttttagttgggctatttttttaatgttataaaacatttgattacagctttttttttcttttttaaaaatagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaagg

SEQ ID NO: 13627 - DNA, 1223 bp, Homo sapiens
cagctgtctggggaggtggtgtggatttagaagcacatgaggttctttggtagaagcaattctttgaaaataagactagaaagatagattggtatttccagttgtagagaatcttgaataaatgatatgttagtttgaattttcatttatagggcatgagaattttactgaaagcttttcagccatgagcaagaagtgtccagggtttaatagaaatctaacttaacttcaccttatgtgtttaatatcttaatctttttagaactttaaaaaatacacttcttgtatatttaaaacatttctagtaaccatgaacatataatttttgatcaaaatttatgtttaggctaacttctgaatttgaaaataggctttctctcgcatttcatagttactgtccagcctatctctcttccaacatcctcatccttgacaatcaaaatttcactttaaaaagctactatcaagtctcagtgtctgtcttggaaagtagtctgtgagttttatttgtgcaatattcggggagtgtaacttgcatagtttctctggtatgtgtcttcagttgagttccatgcagcaggtggtccgagagaaagatgcccgctttgaaacacaagttcgtcttcatgaagatgagcttcttcagttagtaacccaggcagatgtggaaacagagatgcaacaggtgtgttgctaaaactcggtagaatgactgtcattttggttaatatttaatccatcacagccaatttcctacccttacccactgctcttcacttggtgttagtgttttccttattggcctcttttgtgtccttgtcttctgttgcataaaaattatttattttttcttatccttttcttgccttttacccctctaatcaggttgttggtgctcaaaagctgagtttagttggtgaatttatgtggtagtcaaaaattggtttctcttcagttttctgattatagctacctttgtgcattacacacctaacccaaagcttcaaatcaatgaagtcagttttaaatatttaaaaaattagagaagacaaagaatgattttgaagacatgaagtcttttattagatcagtaattcttttttaaaaaaatttgagtagattttgaaaattggcttcattgtatttgagttcaccatctactaactcaaagtattttatttcacttagtgtgtagtgcattgtggtactgaaaggcacttcag

SEQ ID NO: 13628 - DNA, 1200 bp, Homo sapiens
ggctgagggcctgcatttctccttctttccctgcagccctggcccgccaccgctacatgaagcaggcccaggccctaggtcctcagatgatgggaaaacccctgtactggggggcggacaggagctcccaggtttcatcttatccaatgcacccgctgctgcagcgaggtaaactcttccagagatttgggataggggagggcagagggcaagggcgggaacatgggctacatcaagacctctgtgaccgatgcggcaggcatcttcatgatggagatgggagggattcatgctaaccaatgtcacattttgatgtcctgattctgaggtgtatgttttgggccatttgttctattgtcctgtccttgtttccattcagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcg

SEQ ID NO: 13629 - DNA, 1541 bp, Homo sapiens
aatcgtggtaggacagcaagttttgtggagttttaacttgctttattcctgtcttctttcagcttcacaatagtcttgaaaaccaacagcctcacaaatcacagttactttgaaaaccagcagccttgcaggcactgaagaaggcagaatgggtttaagagttttccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatggagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccgagcacgaatggaaggtgtgttaggccagtctcgcattgctaaaaagaaatacctacgactaggtaatttataaagaaaagcagtttaattggttcatcgttcttcaggctgtacaggaaacatgatactggcatttgtcaagtttctagggaggccttaggaaacttacaatcatggtggaaggcgaagggggagctggcatgtcacatgtccagagcaagagcaagagagatcagggaggtgccacacacttttaaacgaccagatctcataagaactcactatcacgaggacagcaccaagaaggatggtgctaaactattcatgagaaatccacccccatgatccactcacttcccaccaggccacacctccaacactgggggttacatttcaacatgagatttgggtgggggtacagatccaaactatatcagaaggctaaggcagtgttgcagactgcctgcctgagggtagaagacatgccccaacatgcacacacagcccgtaggcaaacacttaataaacttaaaggcatttattagtctctccagttactagctgaccactaagataaccagacagacctctgtggccaaacacacaaaggatacaaggagagactatgaacaactctatggcaaaaattacataaaccagatgaaatggacacacttttagaaaaagaaaaattatcaaaactaagtcaagaaaaaataaaatatctgaaaagtcctgtaacaggagattgaactagtgattttaaaacttcctgcaaagaaaaagtccaggcccagatggcttcaattgtgcattctaccaaacatttaaagaaaaaaatagaattaatctttcacaaattcttccaaaatacaaaagaggagggatcacttcccaatacatttgatgaggccacattatcctcataccaaacccctcccaaaaaaatctcaagaaaactatagacccatatatatcccttaggaatattgatgcagaaatcctcaagaactgctacaaaatgaatccagt

SEQ ID NO: 13630 - DNA, 4180 bp, Homo sapiens
ctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctggagtcaaggggtttttctttctcgctagttttgtgaaaatttttatatcaataggcaaatcattataactttttaggggttgatggtttttaagtatattggaaattgtggtgtctaaggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatat

SEQ ID NO: 13631 - DNA, 1193 bp, Homo sapiens
gatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacg

SEQ ID NO: 13632 - DNA, 1197 bp, Homo sapiens
taaagccacgtttagatggatagccatctcattcttgtagccaagcatgtttattgtaatttttcttccatctctgaaataatttgcttgtcagactctatagggattattcctctgtatgtggtactttaaaaaaaaaactttaaacatgtcaaataatggaaaagattggagaaaatatcataaggtgattcatacttaaggccatgacttatagatagaatacatacttaaatttgattggtgaaatattctgcagctcttctagatggcaggtgatagtaaatacacaaaaattgtggttctaccaatagcatattcattccttctataacaaagcttatattaatgagagaacagaagatgaaattaaaacagactttattatctcttaaaaagccatgagacttaacagaagttaaaagcgtgtttttttaattcaggaagaggatcacctagcccgggtagaagaggcaatcacccgtatgcttgtgtgtgccctgaaaactgcagagaatccacaaaataccagagcctggttaaaccccactgaggtaggcggcttctggtcttcatcatggcagttagtttcctgtggtaaaccagccctgactagaacatatgttttccagtgtaactaaatgtatgtaaccattttaaaaggtttttctcttcccttaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaa

SEQ ID NO: 13633 - DNA, 1140 bp, Homo sapiens
aggtcagagtactaacttgtatcttttttttttttttttaattaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggtaatagggctttaaaacattaatgacctgccaggggacaccacagctgtaactctctcaagtccttatgctgtgtgcttcccctccctgcgcagtgcaaatgagaatggcttccttccctctgctctgctgttggaaggtagcttccccagttgtaggcttcagacacatacacctctgcttcacaggtcctggaaaggaaatggcaagagggaacacagctcctcctattggtaaagaggagaatggactttggaggaagacagtctacaagagtcattttcatttaggtcaggagaaaatgttcaaggcatgggtactcgagcatctctggaacatttaatcacagttagtatctgttcaattatgatagcactgaacccagacacataaacacaggtcggaatgcctccaggtgtgggccaacgggcagaaggaaccgagaatgtttgcttttaagcaaaaatggatgttgttttcataaattactaactctgaaacatttccaaaggtactgtacatagtgctgcttcccagtgaggaaaatttccttttcaacattggcacttgctgtctgatatttcattaataatttgaaaggttttcttagtcacttaagaagattttattctctcgattatccctctcccttgcctgtcttccatccattgtaccggtctcactggctcttttcctgcttccttcactcaagtactatcaactcaaacaatttcacttgactgagttgcctcgacctgttagtcactctgcattcccctctccccacagcccctgacaacaactaatctttttctatctctagatttgcccattctggacatttcacacagtgcaatattataatacagggccttctgtgtctgacttctttcacatagcataatgtattcaagggtcatcca

SEQ ID NO: 13634 - DNA, 1124 bp, Homo sapiens
ttttccaaattgtatttaatgtgtgtgtattaacttataattggaactatatatactttttattgttaataagttaaatcataatttctaagtaagtattttggaaaacactatacacattaaaaaaaaaaaacaacaaaaaaaactacctgttgagtactgtgctcactatttgggtgataggttcaatagaaacccaaatcttggcattctacaatatacccatgtaacaaacctgcacatatacccctggatctaaaaaaagaaaagaatcaggtcttttgaggccacatgtgtatataaacagcagtaaatgacgtatacattattgtaattgtagagaatgatttgccatgataaaaacaatattagctattttttctccatattgtatgaaaaaacttgatagttttctatctattgctgtattcatttctctttctaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacaggtatgactataggtaatcaccatcataatgtctcttcaggagcatccctacattctcagcagtggcctcctgatctcttgagaatcctttctttctaatcctttttttgaccattcactgcacatacaggaacattttattggaaggtttggaaaacagtttggcttaagtgttttttgtttttgtctgtataaactatagactgttttgtctatagtttataaccccatacaaaatgtatttgttcatgtatcttatatgtatattgctagacattattgtggttcattaaatgttagacacttaataaataaatatttgttaatgtgctcttattcatgttcctattagaccaatactaatctaatagtcccgtccactttttactcaagtagaatgtgtccttttatttgtggcttcgggcactatttatagttgtatataattacttggttgtaattttatccctctgctttattgactgactgacctg

SEQ ID NO: 13635 - DNA, 1160 bp, Homo sapiens
gcactcctcaaaacattcctctctccctggagcacatgtgaatgattatctatgaattgatcttgagctttcctgtgtatcctttcaggttatattttttcttctgagtttttagccctagttaaatcacacagtcaattctctagaaataggattgtgcagtggaaagagcactggacttggactgaggggacctgataaatctggttccagtcctctgacatctaagcttccatttcttccttcaattaatggaaatgaattaccgtctctgcctgttttacaggcttcttataagatcacatgagcacttttaatgtctgtaaaagtgcattgtaaacagtgaagcattaaacagttaaatgtatggtattgttatgatgcctgtgttcaaaatcaagctactcatcttcccaaaagaatgagctattgctcctgacttctcttatggcaagtcaccaagtctagacacctcagtcttttggctacatctgactcccaccccacatctctggttgtaatagcctttgatattattctcttagtatttcttcatcttcaccatatctgacttactcactgccacccctgttgttcaggcctgtatcatacttatcgcttggctattgcaatagctctctgagtcaacttcaggtccaactctcccttcccacctcatatctctacatatttctagacagccctcatttttagtggatatagtatactatgggattgccttgtcataatttagtaaatatttttctgctttggggcatcaggttgtttacattttttgttgttatagtgtggtagtagacatttgtgtgtgtgtatgtgtatgctgtacatagcttatgattaattatttgttacagtaaattcctttaacatgagttactgagataatgaacagttctttcatttttcccagttgtttcccaaaggatgattccaatttatatcccatgaaaaacagaatactatttatcatgaatatattatagcttttcatagtgtagggatcaaaatatgccacccccaaatatgccactttggtatattgattattttgggtaaaaggcattgaaaaggctgggcatggtggctcatgcctgtagtcccagcactttgggagaccaaggtgggtggatcacaag

SEQ ID NO: 13636 - DNA, 1804 bp, Homo sapiens
agtaatttattttgtaaccaaagtcaaggtggattaaattgatgaaaagttatgaacaatattgattaaaaatattccacatggaagccccgtcatatattacacacatcacttagtctccagattgtcactatttattgaaagccagtttctaggccttccagggtacatttattataagtactttttaatgcagagcagattccttccggcatacaggtggtggtctgctggtgatacatgaatgtttaaaactgcatgtttttttgtcttacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaattccattaggatctagcactttgttacaagtgaaatgacaagtcacatggacatactgtgtcttctgcctgtatatggtggcatgagatgtaatgtccagagccaacaattatttaccagggttagattttattcagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttcccaaaaagtcaagaatactgctatacctttattattctcagcttcctccagcccttcttgtttttcctcacttgaaattgaaccttcattgtcagctaagtatatatacttttgtgttttcctggacagagtgcaagtggctcttatcagccaaggtggtgaaggttcaggaaagctgggcagcactgggccctgctcctctctg

SEQ ID NO: 13637 - DNA, 1155 bp, Homo sapiens
gttcatccctcttccatgccacagttcttcaaacattggaagttgatgagcctgccacctcttccccagttcagcagtcctcctctggcttgtctcttcatctctgggcataggactctgaagatctcccacttctctacagttgaggtctccaggaccaaagatggccctccaggtgaggcctgaccagcatacccgtatgcttagctagtgcatctcctgttaacatagcctcaactctgatctggctgtctttagcagccacacagcactgctgatttcgactgagcttacagccaaccagcaccccagggtctctttaacataacgcactcagccacatcttcccaattttacctttgtgtttgtattagttttctagggcagctgtaacaaaacaccccacactgaggggcttaacaacagaaacttattgtcttccagtcctggaggccagaagtctgagatcaaggtgtgggcagagctccttctgagggatatgacagaagatctgctccgtgcttccctcctggcttccggtggtttgctggcattctttggtgtttcttgttttatagaagcatcaatataatttctgccttcatctttgcaacatgttctccctgtgtgcgtgtgtgtcaccaaatttttcctttttataaggacaccagtcatattgggttggggcccaccctccagtgtgacttcatctaactacatctgcaacaatcctatttccaaataaggcaataatctgacatacagggggttaaaacttcaacctgtgagctttgtggggggacacggttcatcctacaacagtgctgcagctttttgacctcctgtttcgagactacatttttccctaatttattttatcttgaaaaaacctttccagctgatgaagatatttcggatcctgcctctgtcagccaacgtatgtgctattgctctcagcttcaagtgcttcttgtatattgatccaaggatttgctaagaggttgaatggggtggtgtgggttggagctctgcagcatggcccctggacacttccctgcaggcggccaggatccattgctaagcccccttggggtacaactgtgcaaccagctatatgtcccactaatgctactgccttccagcttcctctttcta

SEQ ID NO: 13638 - DNA, 1190 bp, Homo sapiens
ggatctaaacactacagaaatgtcaaatagtaaagtcaaatgcctgatagaggtctaaaggaaaagcagcatacccacacgttcctgctccccttctagctgcctcaccccaacatcttacctcccctcacatctctccacctcccacatcccttctcccaccatgtctgcccctgcatcctgtctccccagcttctgcacagctcttcctcctgctgtttcattgttccttttacgctgaatggtctggtcatggtgactgcccttctcaggccagcttggcggagtctctagaactgcaattgtccagcctgtcctcagtctttgttcctctttccccactctgggaggcgtctttggttttctgctacacagaggcagtgccttttttttttttttaagcctacattaaataaaaaaaatcatccacatctggccctcctgacacctcttggaagcatcttcatgcactttctgaaacagccctccctcccattactcattggccccactctttctttcggataatgagaaaattagatgcaacagaaagccattaatctgaggcctagatattttaaattgatggtaacaggaatttacactaggctgacagttacctttagactttcaatgaacaaagaggttaaaaaggaaaaattaatagtgaaaccaggttttgaggaaggggggtggttattttcgccagcctaatgctattatgggcataggccacacacaaggggcctgcagctgcctgcaggagctgtctgtgacataccttgttaaccagtagattgcgctctttaagtgttttgaaaattttataacatcatccctttatagtgtgacattttcatgaatttgagctatttttctttctgttatgtcaaattagtgaagtgttacttgtaatttccattttaggctattaaaaaatcatccagtctctgccatgagctaggctgtgctaggcacattgctaagctgtgcttgtctcatttctgatataacccatcactggcccaggtctcttctgctccttctgcatgagacttggcaaagccctctacacccccaccccccatcaccccccacaatgctctgggccagctggccactctgccagccaggccatgtgggtggtcctgctcatctcaagactggctcaaggactaaattcagattaa

SEQ ID NO: 13639 - DNA, 1274 bp, Homo sapiens
taatcgtacctttggcaaagcagtgttgtgacgattgagtgcgtaaatgtaaagcacttagagactggcacatcaagtgctaggagagcgtttgccaccacgttgtggtcttccttgttgcagttaaaggtgctaagagtcttttaaattgcaaatgcccctgaatgtcgtaaatcattgcacaaaacttttcagaagccaccacttaagtaagaatcccattgaaatatctagcaggcaggcacttgtgggcagacttctggtcagggcactggaggtgcatccaaagagagaagagggggttgaaggactcacatttgccaaatgcctgctgtatgccaggtgctttgcccaccttaaagtcctcctgagggaaggaagcaggatgaagccctgtgtcacacacctgggagtggtagactgtgctcgccagtacctgcagagtctcccaggcactggggtgctggtgagtgagggaggtgcctctaagaaccttgccctatccagcatggaaccagcattttggtcccaacacacctgacttggaacattcgaatctgatctacaatttgctcatggatggcagcagcccttgtgcccacactctgagggccctcgtgagtgtgcacacgcgttgatgggaagatgaggggtgtggggaggcagccacagccttcagctgcagtatcatgcagatgctggggacgtgagagctgaaaggcgctcttaaattgcacaaatgcaacatggcttttaaaagaatctgaggcaaaaggcaccctccaaaaaaacccatgtgagccgggaggggactgccactatagctaacaaagtggggaagcaattttgcaaagtaagaaaactagtctcaggctaaccagagatgctgacaaacctgagattccaggcagatctaaattagaaatcggtcaagggaaaaccgtgatagtcccccttatggattccagtgagaattctttaaattcatggccctgatggagtagcagtaggagagagaggccctggggatgcaaatgccctcagtggatcagctctgctcactagacacttgggcaggtgaggttgggcgctgggaatcccgtggggacaggatgcctgcctacttggccctcaactctaggtgaatcctatccttctcttcaccgtcttcctccccttccctctctggaccctctgcttgctctgtgaacctggattgatctccactcacccgtcactcctgaatggggccctcgaagggagacacccctgac

SEQ ID NO: 13640 - DNA, 1408 bp, Homo sapiens
tgcccaggtacgtcggcagtggctgggcatcagcgttttgtaatgctgtgggtgattctgttgtgcgccaggattgagaactactgccctgagcctccctcatcagcggaggggtcatgtgatgacaccgagtctgatttatggctgtattgaaaggcaagttgtttatatctaaggggtttattgtggtgattcagtaaggagtgatggccactaaaaatgattgcaggcgtgtaagaggggaagaaaacttggttggtggttggtataaaaaccttgtcaggcaaggctgtggcttagtatatttatgttgctcttatcaccagcaattaaccccaaatgtggctggataaatggcttagtgcagtgctataataactgcaagaatattttaggaaatgactgttacacatggctgatagactgaccatcttagcagagcagcaaacctcactcaacattcctgaaggcttgttagctacaaacaaatgcctattgatccgtcaaatattaactctattagctctttcctcctctctctcatttttttttttcttttgagagaggcttgctctgttgtccaggctggagtacagggctattcacaggcacaatcatagtgcattacagtgttgaactcctgggctgaagtgatccttctgcctcagcctcctgagtaggggggatatgatatttcactgttgagtagggagaaattgtataaacacctgtggccttaataccctcagcagtgttcattagtctttgtgaatctgtctttgactccgctgtaaactagaagtgtctgtagtagatgctcaataaatagctgctggctggatgaatgaatttgctccagtttactcaacaggtagatagcagtgttagtccggcactagtactttttcttcacctctgtagctcatgagaagcacagaattatatagccggcaactccccatatgcgtttgttgttagcatgtgtggccaagactaggaaagttaagaaaggtgatgtgcagggtgaggaaaggatggggcttgtaccctcagaggatttccttcctgtccactgtgtggacagttattttctagcacctttggatcagggcaagaagggcaaggacccttctgctgcaggtccgggctctgggaggacagagaagcagatgaagttggggtctgtctgaggactgaaaaggttggcaagcaccagctgtggggctgggacctggggcctgggaagcatccctagtcaggacagggagatgtcctcaggttaaatcctccacgaatgaccacatgtggatttgtgatgtggtctttctttggaaaggggttatctggggagagttaattttggattttgctttacacttatttttaaagtggaatatttctccagcat

SEQ ID NO: 13641 - DNA, 1201 bp, Homo sapiens
tatggggctaggctgagggtcaggagccaagagcctggtcccaactctgtctgtggcttactgtgagaccctaggcaagttgcttaccctctctggggctcaaattcttcctctttgaaataggaataataacttcatcactagaattcttcacctggttgttgtgaagttaatcagaataaatgtggagataatacatgaatgagcgtacagaatattatttggctgttctgtggcatcgatataggtcatgatagtgacaatagtgtctgtcattgtattccacaccacttcttccctcagctaaagcaggaaaagaaaggaggtaagtctctctgtgttttttcttcctttccccaagcccactttgttaccttccttggttgctggatgagaaattagtcagagggtcagagaggacctcaacttcatatgctttaaatagagcatatgcaattttaaaccatcctcttaaccaatttttcttttcttttcagtttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttg

SEQ ID NO: 13642 - DNA, 1185 bp, Homo sapiens
tgtattagtatttcatatatggatgtaccataatttatgtagcattttaagttgtttccaacttggcactattaaataattgctgttgtgaacatccttgtatgtatctacaaggtgggagatgcttttgcacatgtaaaactgtttctgatgcttgataacctagaagtagaataattttgtcagagattatgaacattttacattttgttggacatttcaaactgccatccagaatggttatactgatataatcacatgaattgagttaattcatttcctgtactatcatcagaaaatgttatttctttttatttttgtcaattctatggccaaaaagtaccttcttttaaatttgcaattcttcatgttagtgaagatgagcatttttatcatatgcttataggccatttctatttcttaggtgaactgctcattcttatcctttgtcactttttactaggttgccttccttactgatttgtaggagttctttaaatgttatggaccccttgtctataacatatgtgcaggtattttctttcaggcttttaattctacaggtttcaaattttgctatggttaaatctttcgttcttttccttgatgcttgctggatattgagtttcacttagaaatgccttcccgacttcaagattatgtagatttccccctaaaacttgtatagttgggttttgtttacatattttatcactttaatcaactcgaaattaatatatgtgagtgatgtgaggtagggtactatcattttagagttagtaccaaaaataaatattttaaggcaaaatatttttaggtaagtaattctggaaagataatagaggtaacttttgtccccataagcgataacttcttagaagtaaagaaaacacttgcatatgtttctatttgtgaagcagatacatattgtgaagttcattgtaacagggcagatttgtagcctgttaatattctcgttacttaagaccattaacttttccatctaataaaattattagaagcatagatttgtgtttcagcatatgacaaacatcaggcagatagatgtctgatagcagtcagtgcttgtaggtattctagttgatagtaatgacaaatcttttaaaaagtagatgattaactacagtgatgaagatacacagaaagacgatgagaaacagcatg

SEQ ID NO: 13643 - DNA, 1200 bp, Homo sapiens
gagccatgatggccccaccctgcactccagcctgggtgacagagcaagaccctgtctcagaaaaaaaagtaaataaaatttcttctcttctgctcttccttgagtgaccttctttctcagccctctctaagtttttttgtttttttgaccaccttggcgatttggaaagtggctcttgcccaccacatttatatccttgatattcagctgccttggtgcgtccccaagtgcgcctttgtcctttgtccacgtggaggccagcacggcactctgagattgaacaaaagacacaagatgcctgactgtccacatgtctctctctgctctttcaggagcggaagctgcacatctacgtgtggtattgtcagaataagccgcgctcagagtacatcgttgctgagtatgacgcctactttgaggtaagctgtgcaggctttgctgaactggggtgggaggaaaactcaggccaaaacagccactttcagaaataccagacgtcatccatccatatgtgacccccacacagcaccgttgacccattcatggcaggaatagctgcctcaacagagaaagcagcttcttagctaaattctcatgagcaccttcacttgagaggagctgaggtggcccagtctgggttctgatttgagaatcccccatttgcagaataagcctgaacacagagatggtttgagaagctccagttcttcttaagtgaccctggagcagactgtacccaccagtcccccagggaccacttactaaggagtcttctgttggttgaagggtttgcagccacttcctagtctgcttggtctagcccagaaggatttattttgctgggagaaaggcagcatcatcacttagaaaaagcactcagctgagtgtttggagatctaagtttagggcctggctccataggcttgtgtgtcctagaagaagccccttttccctgcctttgccctgaagtggtggagagaataaggcccctccagcttttctcccaggactgggatgaagaccaaggtgtggaagtactcactgtaaaagcatgggaggaaggcaggaagccagtggtgatgtgtgttatgtgttgttcataacaagtgaacagtcctctaggcaattttacctctcacattacttaaagattcttcaacttcattggaaaacatgcagacctgtcttccatgcctttga

SEQ ID NO: 13644 - DNA, 1166 bp, Homo sapiens
agacctcatctctatgataaaacagatttttttaaagtaaaaaaaaaacctctctatttgaaaatttgatcataaaacacattaagcagtgtttataatgtgaaataatttacttgatttactataaatatactgtatgtgtaactggcaagtttggtatacagagttggctttatacataaatatactgtatgtgcaactagcaagtttggtatacagaattggtatacacatatactgtatgtgtaactggcaagttttgtatacagagtgtgtgtacgtatatacgcacatatacatacatatttaaatttggaatcagcaaaattttttcttttctaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggtaagtgtattattcaggaatctgcaagaatcagaaatccagcttaaactgaagaagaaaaaggaaatgctcatgtcattgaaagtccattcatagagcaggctgtcaagcgtggttggatccaggagctcaagtgatatcttcatgacttg

SEQ ID NO: 13645 - DNA, 1387 bp, Homo sapiens
gaggcgctgggcgtgcctcaggaagagtctgaccagtctcagagagagcacagaccaacaggaaagctcagattcttatggtccattacaacactcacacctgcagtctggtcaccccaggcagactgcaaatgcccagaggactgagcgcagtcagtttctgctgaacctgggcttggtttctgttaaagctggaagggacttcagagaccttctgacccaactcctccttccagaggtggatagtgaaagcttagagaaggcgatggctttcctggggaacacagagctgtcctagagcccacggccgtctcctcctgagtgctctgcctgctgctgtcgcagggggctgacctgggaagggatcctagggcctgcgtctgtcggtttgagtgtgtgagctaacatgtgtcctcatcctcttccccgccgtgttctgtaggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaaca

SEQ ID NO: 13646 - DNA, 1142 bp, Homo sapiens
ctgcacatcctggtcactgagtggattgacatgacaagattatgtgatcctgtgatcctttgttgcgtggcagcaacattgatgtagaagctggttgcatggagtaactgcacttacattgccctcactgggcatcatccatgttccttagcccagaggacacttcctctccactctgcctaggctggcccacaccccgggtcccacatacctttcaatgcctatgtcaagtcttcctccaaccacagtagcctactattatctctgtttcctttgaacaatttgtccataccattcatttataacttggcatatactgccttgcctgcagtttagggctgatgtttggagaacaggaactatgttatttatctttgctctctctgctgtgcctgtcctggggcatgtggtaggtgctgggtaaatagttattggtgcctctcaaggcactcagtgaatgctcagaacacttggttaagatttacagacaatgatggaaaagtgactcttctcttcttcctctctagttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggtaactttcctttctggtcctgtccctgcatggggaggtcaaggtagagagcgtcagtgggtgttggtacttcctgcaggagtctttgagtgccccagcatgtggctcctgaccactctgaagtcagagggtgagctcagtggaacttctgggaaatctacagcagtcaaatcagccggagctcgggaatggattgggctggtctgtgtctctgtgtcagggtgtggttgtgtgcaatggagtactgtctgctagaagacagctgtctgcatttatacattggctttttggtttattttcaggggaaaaaagtaaaggtcaagtcataggcatagaagcttgtagagctttctggaccaattttggcaaaccttagagattgctctcttgggaaacccagttgaaaaagaattgtgtgaggccgggcgtggtggctcacgcctgta

SEQ ID NO: 13647 - DNA, 1168 bp, Homo sapiens
ttctcctgaatgattatccagcatccaatgcctgtgaaagatgataagtgaacaacttaaaggttaactcttgaatgcccaagggaagacttttcagctacttatatgtcatcttatttatttaactatatattatttcatctacttatttatttatttttagagaggaggtctcattatgttgcccaggctggtctcaaactcttgatctcaagcgatcctcccacctcagtctcccaaatagctgggattacaggcatgagccaccatgcccagcaatatataacaacttttaaaaaattttagctatacaacttctgatcatttctgtttctcttgctaatcatgtaggcagttaggagcattttaaccatcaaaataacaacaaaaccgaacatttttattatgtgtttacagtttacaaaatgctgtcatgtccagcagctcagttaatccttacaatacttggtgaagcatctgggatagggattaccatttcctccattttcagacaatgaaaatggaaagtagagaatttaaggtcaaccagatggagacgcagccacgacatgcgatgttttcgggagacaccctgaccacctcctgctctcttcctctttttccctgcctaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgagttgcccacagaaagggctggatgctctgggatcaggaaggcccatgggggaggtgggacttgttaataatgggacaatgagtcaggccaggctgagatcagagccacgagatggtgatggggaggcaaggctcagacctcaggaagcagagtatattcttattgatgtgtctgtggacaggctcctgtggacagaggaagatctttgctatttttaaacaattgtggtgaaatatacataacatttaccatttaagcgttttcaagtgtacagttcagcagcattaaattcacaatattgtataaacatcagcagtatctatttcc

SEQ ID NO: 13648 - DNA, 1209 bp, Homo sapiens
tgagtaaaatgaagtacattcacctagatagtccttgggtagcctttgccacatatgacgttgaaaaagacgtgccactcacttttttttttgctaagttttagataattttaaaaataatactgacctatagagaaatgaagaaaaatctggtttactgcagtgtccttttaaggctctgtagatgggaccccctgtgtgttcttgttctatatttagttcttgaataactcggactgagaaatccggaggcctctttagcccagtgtcccatcttcttcctcccatagtcttttcatctttgttatcactgacagccagctctcagcttgggttcctccttcattctttagttgagatgtagacaagtagaaatggggcctgaggcaggttcacgggtgggaagggctggtttaaccctgcactggtcccaggcactgtgccttggtgccagtgagtgtgtccgatgggggtgcagggttctcagcgctgggcggttctgcccatgggcccatggctttctgtcctgctgactcttctacctggaatcgcatgtcagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccaggtaagcctttcagagtccagtatgtggccttatggatcttcactgctttagagatgtttgtaggtgtgagtttgcccaccccatctccccctaacccccataggctttacctacaattggtgtgagctgttcctggatcaggtgagcaggtgtgtcttggagcagcttcatgaggctagaagctcctcttcacacagacatcgcctagcacattttctatgtgtccttttattttctttttttaatgtatatttatttatttattattattatactttaagttttaggataacatgtgcacaacatgcaggtttgttacatatgtgtacatgtgccatgttggtgtgctgctcccattaactcgtcatttacattaggtatatctcctaatgcaatcctcccccctccccccacccca

SEQ ID NO: 13649 - DNA, 1099 bp, Homo sapiens
gaagagggctcatgaccatgagccccaggaggtgaaacccagaatctcacactcacttagaagtgtcatctattgcttctgcctgcattccatgggctagaactcagtcacacagccacttctagctgcaaagaggctgggagtctacctgactccctgactacttgagtgatgaccagaggaaaaggactacgtttgtgaataatgagtctctgctacatatggatacggaatcactgttgttacaagagaacagtgatccttttgtagaggtatgcttcaagatgtgtgtgtgcgcatgtgtgtgtatgtgcatgcatgtgtgtatacacacacacttgccctggcacaataagacaggactgtttttaagctgagttctcctacctccctcctcctgttccactctcatgccatccctggccctcccaatggcccctcagctgatttctgtgtgttctgtttgcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtggtgagtgctgagttggtggcctggagcctctcacgggcccaagacaggaaagctctgccactcttgcattctacagtgcaggccacagattcctgaagcacagatgctcctgaaacacgaaacagaagcaagcacgatgaatagctagcattgcttgttaaatgagcatcctgtgaagataggcttccgaatttctaatggaaacctcacaccatagatttaactgcagaataggagcacagaagtcagggctcatcatgagccggacttgagatgggtcagagagatcagattgatggcaattttgcctccagcttgtggccctctgtagttttcccggtattcttcacttcatcttgggcccgcccacatggttgccttcccccaccacactgcaaccctgtaggtaagactgtgcatggggatgcttggtcagaggtgtgggccgcctacctctagggatggattgcctaggatggactc

SEQ ID NO: 13650 - DNA, 3060 bp, Homo sapiens
taatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttctgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcagtatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactg

SEQ ID NO: 13651 - DNA, 1446 bp, Homo sapiens
tacttcaacattggatgtattttttaagagtcattatcagtttggtagatgaaatatgatagtgctgtttaatggtaatttcttggattactgctgagactcttttttatatgcttaatgactatttctaaatttttaaaaatgatttgcttgatgatgttctgtcagtttattccttactgaattcatctctatttttaacacatttcaatatattattaatatattaaagaatatggatcccttgactgatgttacaaatacttttccctaatttgtttttatgtcaggcttatttttcaataataaagtagttaggatttgatgcctttatatgaaaatgaaaatttgtgttttattctaccagcctttggaaaccgatattggtattataattttaaaattggaggcagttccaaagtacatcaataaaatctttgtatttgaatgttcaaattcttaatttgaaaatttaaaatgaagtagtcatataaaactaatttactatgttttgttgccaaacttggttttctaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctgtaagtaattcctttataagatattaaacttagaaacataattttttgttacgtaatactgcaagtcatcgaagaaatttcagaaaatgtttcagggctaaatagtgttcttgaatagatatactaaaatattgacataaatcatatttgaaaggcaaaattaagttcttgtattatattattttagaagcttatttctttcaggataacaatatttctcaggattattttggtattaaattttaaatgcttaattttaaaagatattttatctaacttctaggtttctccttaaagagtaaaacatttgaatcttcaacgtaactagaaaaatatcacacattcaagggtttttcctacaaattctgtaattcttgccttcttaaatttttctaatatgctcctattctctgttctctttgtatcctccgcttgcttgatctgtttatctttttaaagtatatcagccctttactctttcctatctacctcagacgtcatttaagatgtttcataagcacccatatgtttttccttcttctacctttatttttacccaata

SEQ ID NO: 13652 - DNA, 1099 bp, Homo sapiens
ctctgttgcccaggctggagtgcagtggcgcaatcttggctcactgcaagctctgcctcctgggttcacgccattctcctgcctcagcctccgagtagctgggattacaggcgccggctgccacgcctggctaattttttgtatttttagtagagacggggtttcatcatgttagccaggatggtctcaatctcctgacctcgtgatccgcctgcctcggcctcccaaagtgctgggattacaggcgtgagcaactgcgactggccggcaattgttctttataaggccaagtttatttctcatttactgtctacttaccactattgtattttcccaatttcaaacataaaaacaagtcagtacattggtcattcagtcataacttactgtatttagaaagaattttcacttcagtattcataccaatttgcacatattatatttgtatagtatcttttcctaccataaataatgtttgttgtgtgtgtgttttattgtaggaatcggatggcataagtgattaaggtggtattgaggatttctgaagcctatgaaaggtagaaactcaaccatgatttctttttcaactctacagcattcctttccttgaagtcttcgtttttaccttagtctcgggtaattttaatacttatttttcataatcttgaataaataagttttttcaaatatgaagtcattgtgttcagctgctagaattttatactgaatttatataatagtttcttaaagttttggtatttatatttggaagaaactagtttttttcctgagaaaagaaatttaaatgatgaataatgatgtcattttagactctaacacaacaaaaatgtgtagtcttaagtgaaatttaattgagagttattttcttggtttaacactttttctcaacagggtatagcattttttaccccctatcctgaacacatatacactcattaagtttcccagaattttcagagaaactgttttcataccgaggaaagttagacatgttagtcaaatttaatgatgtttgctatataatttttaaaatgtgagaaaacatatcagtttttatacatctatacatgttgtatgt

SEQ ID NO: 13653 - DNA, 7989 bp, Homo sapiens
gcctctgctgctgatctgacaggaggcagagctcaggtggtcgcttgcctcctgctatgcagcctggttccaaacaggccatggactggtatcactccgtggctctggggttggggaccccctgctttaaattatctctagattattaatacctaatacagtgtaaacactggtgtctcatataagtggaatcatacagtatttgtctttttgtatctgtcttatttcacttagcataatgtcctgcaggtttatccatgttgtagcatatatcagatttgattccttttaaaggctgaataatgttccattgtatgtgtatgtgtatgccgcattttgtttatccattcatctgtttctgtttccttttagactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcaggtaaagatgctgcgatgtttaagtaagctaggcttgtagactatatggtagattattttatttatttatttatttattttggtaacaattcccagcttcattggcatccctgaatacagcctattcctttaaaatgcattcctaagaaatttgagttatcacgctgggtgtggtggctcacgcctgtaatcctgacactttaggaggctgaggtgggaggattgcttgagcctgggagtttgagaccagcctgggcaacgtaggaagaccctgtctctacagaaataaataaataaataaataaataaataaaaataaaagaaagttgaattatcaaaaataatgttatagaaacagttgtttcaatgtgggggaaagagaaataaaagtttcaacttcataatattattttcctgcactattcctgatttctaccctttgtactttccctccaccatttcttctcccctcccctccttcagtacccagctgaagtgttacttcattgtgaagccttctcaggctatcacggcatttaattcatgccagtatggtatggcagttttgtattagatgattgattgttctgtgtgactatccctggctaaatttaagcccttcaaagtcagtgattgtatcttttccacattcacatcccagtgccttacatagggcttagcatgtaattgttacataagtatttctagaaattcagttctcagagacccactatcactgtttgactcatttttcttatttttgttttcatctgacagtcagtgaatagaccaaggcagaccaagagtgtattttgggttttgaggtggttttgttcatttttagaactactagcaccaaatatggcaaagtaatagatagaattaaaaaagacaggccgggcgcggtagctcatgcctgtaatcccagcactttgggaggctgaggtgggtggatcatgaggtcaggagtttgagaccatcctggctaacatgctgaaaccctgtctctactaaaaaccaaaaaaattagccgagcgcggtggcaggcgcctacagtcccagctactcgggaggctgaggcaggagaatggtgtgaacctgggaggtggagcttgcagtgagcggagatcacgccactgcactctagcctgggcgacagagtgaaactctgtctccaaaaacaaatacctctcgggattttaatttttattattatttttcatttttttgagacggagtctcaccctgctgcccaggccggagtgcagtggtgccattgttgctcgctgccacctcaaagtccagggctcaagtgatcctcccatctcagcctcccgaatcactgggactaccggctaccaagcctggctaaaaaagtttttaaactttggttgtgatttaaaacaagtacatgcagctggccgtggtggctcacacctgtaatcctagcactttgggaggcctaggagagtggattgcctgaggtcggaagttcaagaccagcctggccaacatggtgaaaccttgtctctactaaaaatacaaaaaattagccgagtgcagtggcgtgtgcctgtaatcccagctactctggagactgaggcaagaaccctggatgtggaggttgtggtgagccaagatcacgcctctgcactccagcctgggctacagagcgagacttggtctcaaaaaaaaaaaaatgctaaacgtgattcataatccatcttgtcaaaagagtgtatattttccagtgacccctggaaggcacttacttcattgtgactgacacctgttaggtttgtgagctggcttaaggagtcatctatgtgtattttataggaataatttaaaggtagaatccttgtggcaaaaacttagattattaggccaggtgcagcggctcacgctgtaatcccagcagtttgggaggctgaggtgggcagatcacctgagctcaggtgttcaagcccagcctggccaacatggtgaaaccctgtctctactaaaaatacaaaaattagttgggcgtagtggcgtgtgcctgtaatcccagctactcaggaggctaaggcaggagaattgctcaaacccggaatgcagaggctgcagtgagccaagatcacgccactacactccagcctgggcaacagagtgagactctgtctcaaaaaaaaaagaaaaagtagattaaaaggtacaagaatatatgactgtctgtttgctttttccctaactataatttttaggaaaataaaaaaactgtcttatacaagcaataactcttccttctacataggcaattaaaaaccaacgccaatgagaactggttaactttttagtacacagtttatttaacttaaataataataatggctataccttttatttcagagaatttgtgaaaaacgcatgggctgatattgaacgcttcaaagaacaaaagaaccgagacttaaaggaggccctcataagctatgcagtcatgcagatcagtatgtgcaaaaaggtagggtttttcctgtttcagtgaagatatatgtatattcagaagtgcttatacatgtatttaaattacctgaccaaaaaatttttcatttttattcttctcttgtagaatgtttaccaatttctctattttaattttgtaggatttctgttttattttgttttggtttttttattttaaaattttaaatatttaaaaaatagatatgggggggtctcgctatgttgcccaggctggtctcgaactcctggcctcatatagtcctcctgcctcggcctcccaaagtgctgcaattacaggtgcgagccaccatgtccagcctctactggtgttacaaccagtatgcccattactgagtctccactcatctaaagtccaaatttgtatctccatttataacttgtatttgagaatatataccaagattatttagatcatatggtactcttggaccagacagtaaaataccattccaggtatatgctttgattggaaaatagcttgaacattatttcgtgaagacctggttatgatatgcttcctcataaagtaaatcatttgtgttgctgatatccatagtgaaagatacaaacattgaagcttattctagttaaaataaatgtttgacaatgatggaagactttctaaaacgttggtttaagaacaaaataggaaacattccttaacctcttttttataacctaagatctgccagtgtgactaccagtaccagtgctttgatttgtatcacctgtcataatttatcaagcacttttacatgcattatctcagtaaattacatggtaagatgaattctcacatttatagggcaaaatcacactcatataaatatatatacaattcttatgctttagtttgtcccaaaattttattttttggctgtgggccatcactgagagaacaaagatattttgaggcataaacaccatacgcactcactggttaagtgggctccatttggtttggacaaattcatatttatgctcagtgaattataagttactgtataccgtggatctttggagtcacttaaaacaagtttagatcgtgactgttgagtctgcaggtgctaaaggttgagtatgttgtagtttggtagcatctctatcttttttttgccttcattctgtcacctcttcttgcctgcagctaggtgctagatatttacaatccattgtctttttcttttttcttctttttttgttgaaatggggtcttactgtgtcacccaggctgatcttaaactcctgggctcaagcagtcctcccgccctggcctcccaaattgctgggattataggcatgagccaccacacccagtagtacagtcctttttccaatctaactttttaacctcaagaaatctgaaagaccagataacaaaggtttttagtttttttgtttttcctgtaaaagactcattaataagctccttgtgatctctcattcacttctttccaaagtaaagtgcaagacctttatataatgtctcaaaggactttccccctccgttttgtttaggctgcagtggttgagggtgctagaaatttaatctgtgaatataaaagatactactatagctgtatttggacatactgttggatattttgtaggtttattcacaaatccttagataactagtaaaacaaaaagtttaataagagtttatgttcaccttgtttcccaagaatggtactatgcaattttgtcgttttgttttcttgcctaagtgatatagatttttatatgtgatcctagctatttgggaggttgaggcaggaggatcacttgatcccaggagttcaagactaggctgggcaacatagtgagaccttctttctttctttctttcttttttttttttttgagacagagtctcaccctgtcacccaggctggagtgcaatggcatgatctcagctcactacaacctccgcctcccgtgttcaagcaattctacctcatccagccgagtagatgggattacaggtgtgtgtcaccatgcctgactaatttttttgtatctttaggagagacggtttcaccatgttggccaggctggtctcaaactcctgatctcatgatccgcctgcctccacctcccaaagtgctgggattacgggtgtgagccaccgcacctggcccgagaccttctttcaaaaagaaaagagaagaaaaagaaaattgttcaaaaccttaataaatgacacactttaatgattaagtattaaaaagttcctttctcataaatgagtaattattggagaatatgtatcttattgaaaaaataccttactgaaaaaaacccttgccgggtacagtggctcactcctgtaatcccagcattttgggaggccaaggcaggtggatcacgaggtcaggagatcgacaccatcctgcctaacacacggtgaaatctcatctctactaaaaatacaaaaaattagctgggcatggtggcaggcgcctgtagtcccagctacttgggaggctgaggtggtagaatggtgtgaacccgggaggtggagcttgcagtgagccgagatcgcgccactgcactccagcctgggcgacagagcaagactctgtctcaaaaaaaaaaaaaaaaaaaaaaaaggaaaaaacccttaagttttactgttacatctctataaacatgtatttttgcttatgcatattaggccatctataactgtgctaagtaacttcaggtactaagagggattcagtaatttagtacataattagtttttatcaaaactttagttattagagtgataatttaataactcaatttatatttgttagactaatgaagttttttgtttcaaatattacattgaaaaaaccgagccgggcactgtggctcacacctgtgatgccagcactttgggaggcagaggcaagcaggtcgcttgagcccaggaattccagaccagcctgggtaacatagtgagattccatttctacaaaaaaaaaaaaaaatacaaaaaataagccaggtgtggtggcgtgcacttgtgatcccagctacttggcaggctgaggtgggaggatcccttgagccctggaggtcaaggctgcaatgagccatgattatactccagcctgggtaacagagtgagaccctatctccaaaaaaaaaaaaagactgaaaacttgtttgatttacaaatagaaattactcgagtatgtgatatgaaatgaattaactcagttttccaacaagttgtaggagttctttttccattttgaagataagttcgtattagagattctgtttctcttttcagaagcattagacatttgcttatattagccacttcccaaaatagtgtcatattttctcgacttcttaattattccaaaaagcaaaacttagtgtaccactaagccaagtacttgggttttcagattccttccaaactcacattttaaagtttttatttttatttttagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctgattttcagatgatttttgttaatttaacaaagtgatccatacatattaatatctgatgctctgtaagaaaatgatatctgtcatactatgttttaaagtgattaatgccacatgttctcacttatcagtgagagctaaacattgagtacacatgaacgcaaagatgggaacaatagacaccagggcctccttgaaggggcagattcggaggaaggcgagggtcgaaaaactagctattggttactatgctcactccctgggtgataaaatcatttgtacacgaatccccagcaacacacaatttacccatgt

SEQ ID NO: 13654 - DNA, 1457 bp, Homo sapiens
aaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaataatgcttctgtctcttttacgaatggagagagaaagtttatattcagtagagttattgccctgttcatttgagaggggcatggattttctgtttaagtccttcaggaatcttcagctaggtggtaaatttaataagagtttctaaaaattgaaatgtttaacttttaaatattctggagatagaagaagaatataaaatgaaaccaggctgatctgcatgcagtggcatttacaactaactgatcacaaccaattatagattccttattttgtttattgtgaggcagagtctgactctgtcacccaggat

SEQ ID NO: 13655 - DNA, 1454 bp, Homo sapiens
gcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtgatggcgcgtgtatgttttattattgaggttgatgtgcacataatacgtcagtgtatatttttaccgagtgaggtctgtcttgtaaaaggagacaaggtgatcaccttgcccatgtttatttgtaagtctgtcaacttagcaatgacacagggtcactcctaaatgacttttttttttttttttgccttgtgccttttgaagtatgtgttcattcagaggctgttttgattctcagactgaatcattcaaactctgccctgtgtttgtttcttgaatttgggggtgacatcaagtttgagtgagtcctccctctgtcttgtctcactctgaggtgctgtccccaggtgctgttccacgtggaagaatccacacctcgtcgacaaatgggtcttctccacagaccggcgctctgtcaccaactaaaggcgaggggagaacttgcccacctggcaggctctttagccccaaggtggcccggagtcctcctccctccatgggaggcttttggccaccatggcgggtggagccgcacccaccccatctccatggggaggagagtcttcccccaggaatgccctctcggcctctatttttctcccatgtgcctccctgggaacgtcaccgtgaagtgactgggactggcacccagtgttctgggcaccaaggttccctgccggtgatgggcctaactcctagtgcaaatgaatgaaagttttcttatagtcatgcaccgaaggtttttcaccttggcttaattcaagtagctacatatatggcattcagcccattgtttctcctttagttggtagtgctggccctgccatatacctagctgcctgcttgtatttctttggtctttgcacagaggctgatctcacactacactcagcgtggaattagctttt

SEQ ID NO: 13656 - DNA, 1206 bp, Homo sapiens
gccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatcaaaatggtgagcaatagagcactgttcctcctggggtggcctggtgggcctgagggactcaggtggtgatgaggagtggccttgagtccctttcctttccatgggacagtggggacgagagctagagtgatgaggcaggttaagtgtgtgcctacctccctgtggctggagcactgttgtggccaccccgggaccccctgagcctggtgtcgccctggcttgctggtcccagcctagggagtgggcccctatgggcagagggtgaggtggctgtgctggcactgcagctcaggcacacacacactggagtgttccaatgggtgatcaggttggatggagccttgaaattaagtcagtgatgtaatttttataatctgtttcactttaaaacaaaaatctttgcacacctggtccaagttttctcccctttcttcctgttgctgccatgatgaaagcagaagggaccaccctccagggagagcagcaggaagggagatgcgggtaggggccctgggtcagcaggggcggtcagtccggaggtgcacccccatttattcctcgttctggaagagatttctagtcacatgcatgtggctcctgtgccacatgtgtcatgaggtgcccaggtgggtttggatttggatgagggcatctttgaggatgcaggggctttgtcataccctgtgggccccgtgtacacccctggggcagatgtggcctct

SEQ ID NO: 13657 - DNA, 1123 bp, Homo sapiens
agctttgagggctgctctttttctcttcatagcgataagtgttaaactgtctttcttaggaaacgttcacagacttgcaacagctgatgtcctctgagtactgtctgactccctcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaa

SEQ ID NO: 13658 - DNA, 1157 bp, Homo sapiens
gtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagaggagtcgagacataagccaccttcagaggttcaatggaaactttaaaaccataccaaactcttttttaaaattagaattaacaagaaaaaaaaaaagggtggggtttatgagccttagttcttggaggattataagagtacttccccagttttgaggctggacagttaatatactttatatcaattatacatttaatataatttaatttaaaataatttaaagattcttaggagatagtctgactttcctgacctagatgggaatgatcagatagggattttttttgtggcacaggctaaatttgatggtgacatttatattgttgagaatgttacatcttattttaccacaacttttaaaaaatgttacatcttttgcagtaggatcagttgtgaggcacatagtagctgaggctccatggagccacctttcatttctttcagtcagagaggaggacagtctctgtctctgcatttctggtgtcttgcttgtcggtggcagagccatgcttgccggcatttgcttaggcggccatagtagttgctaagtgtacaggtgactgggcagggatgggaggtggccacaggtcagagacaagtgctcagtcagtccctggtgccaggactgtgtgcctcggtgccttgggaaatgga

SEQ ID NO: 13659 - DNA, 1248 bp, Homo sapiens
tcagaatgtgtttttttaaaacaatactaacatctaaatatgtatttgttttctttctcttgaacaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctataaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggtaatattaagtggttgcatgggaatttacaaacatgtcagcatttcagaggtccttcaagacagaggcccatccaaggtccttttggaaaacctctgtgttcttgagtatgccacacagtagtcaatgcaaggctcttttaggccacttgctctcatgagccacactagctgtttagcttaagattggataggctggggtcacaatttctagccatttgtcttaaaagacaaatgttaagctaacagttaggaacactgt

SEQ ID NO: 13660 - DNA, 1248 bp, Homo sapiens; identical to SEQ ID NO: 13659

SEQ ID NO: 13661 - DNA, 1214 bp, Homo sapiens
cgccctggtggctttgtgggcgtgaggcttgggaggcctggaggccgcttagctgggaagcctgacggtgccatcacctaacagtactcctacgaggggaacgatgtcagcgacctgccagtgaacctgtcagtcgtgtggaacggcaactttgtcattgacaacccacagaacatccagggtgagtgggcgccccggcggggtgggcagtgggcgggcccgagctgaccgcacccctccccacagcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaaggtagggcccccagccctgcccccacaccccatgccccgccctgcaccaccgcacaccctacgccctgtgggatgcctgtaccccagcctctgcctccctcagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagtgagtgcagccctgggtgtgtgcggggcgggacgggacggggcggggctcctgcagcccctgaggcccgcctgcccacaggatcgtctgtgagatcggggacgccagctccgtgcgtgcccatgacgccctggtggaggtgtgtgtgcgggactgctcaccacactaccgcgccctgtcacccaagcgcttcaccttcgtggtgagtctgctgccctccctctctccctattctctgctgctctgagagggtgccgctcagggcttctgtgcctcttcagggccccttgtctggccatgctctgccactgcttttccacggcctgggtgctgcccctcccctcctgtgcctaggccagctccagggctccctggctcaccttgggctgtgcctgagaaacctggaagtactggctctgaagtgcagctcccgggcatgcgggctcctagtctggggaactgtctgtgggggtaagcaggccaagtggggcctgtccccatgtggcccgagggggacttt

SEQ ID NO: 13662 - DNA, 1127 bp, Homo sapiens
atagagggtggctgccctgctctgggcagagactctgggaggtggtgggttccagtgcactctgggaggcagtgggctcttggagccctgagggggatactcaggctcatgagaggggcaggtggagccattgagggccagaggggatgggacgggtttggggtggggcccggagtcctgctgcagatgtgactggagaggctgggtccccacagaagcctcggtgccaggctgaggagttggggccctaaggcttgcggaaggcagggcagacccccttaggctggggctgctgtggcagattgggagggctgtggcacattgcaggggactatggcaggttaagtgtgctgcagcaggggcggaggtatgtccctgccctgtgctggtgctgagagctgcaggcaggccccgtcccactacactgctgtgatggaggagggaaagagggccccagcggccccaccctccagctccctcctcccccagagtggcgccagggccgcatggcgcgcatcatcctgcaggacgaggacgtcaccaccaagattgacaacgattggaagaggctgaacacactggctcactaccaggtggctcccggccctccgaccctagcacaggcctccctccccttggggcttccacagcgcagccaccaatgtttgcagcatgtgggctggacagcagctggatctgtcagggagaggaggggaggtggtcacttatgtgtgtggaccgtcccaggactcgagctgggcttgtgggattgcctagcatccctgggctgtcctgatatagagttccagactgagtgaggtggctgcctccaggcacagcactagggtgtcaccggggtccccagccggggagtgggagcctggtggtgcaggggcaccctggtgggtcacagggtccctggccctctgcccacaggtgacagacgggtcctcggtggcactggtgcccaagcagacgtccgcctacaacatctccaactcctccaccttcaccaagtccctcagcagatacggtgaggggccaggcagcgggcgagagggcagcgcatgggtccctggcctgggcaggacgtcccccgggctcccacgctgcagcagccggacggg

SEQ ID NO: 13663 - DNA, 2545 bp, Homo sapiens
cccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagaga

SEQ ID NO: 13664 - DNA, 1106 bp, Homo sapiens
tccatcatatggacagatcgtgttttgttcatccattggagatcttttctgagccttctgtgtttctgacctggaagcgctgagcctacccacaatggggctcctgaaccttagggaacaggcccagttcctggatggggtttggtgcttagggttttcctttttggcagtaaccacatctgttttggtgctccctcagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtaggtccagttgtctgcctgcccgagggactgggaagctgggaaggagtctgggaggggagtagaaggtgctggggatgaccgcagtagcaggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaaggtgtggcttccctacgcccccgcctcagcccctgtagcgcctccctaaatcctccccagaaagttgtctgagccgagtgaacacgtgaagcacagggcatatggctgagaggtctgtcagagaaaccaaaagttttgagttttgcatcagggctctcctgctggctatgcagtgaccacatctgggccaccaaagcgttttttgacaagcttgaaaatggacagattttatataaaaatctggattactactttgatctttgtaataggaattgactctttttttttttttttttttttttgagacggagttttgttcttgtttcccaggctggagtgcaatggcacggtctcggctc

SEQ ID NO: 13665 - DNA, 1101 bp, Homo sapiens
tgccacactgcagcatcttttcttgttagtgcatacagagcaattgccttcttttaaatgactatcatgccaccagataacgcagtttatttagctctccctttggagaacacttagattgtttctgatatttcacattcgccaaggacatctcgtgcaaccctcctctgcacccgtgtgtgtttccctgggagtgcccagagtgggactgcatggcgtagggcattgtatccctttctagagggactgtgccttaccattcctaacaagtaggttgaggaattggtgggggatgcaactgtgccctcctcctctcacttcccactctccccctcccccgcttctactcatcccctccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaaggtgggtccctgggtcacggaggctggtggaactcagggggtgtgtgtgggcttgggccttagcgacgggaatggtgttaatggggtccattgggacctcatcggagacttagtagtaggggcgtgaaccatgctaagggtgggccattttaatcttgcagatgaatgaccaggacagaaccagcatccatgaggccatggagcaacagagcatctccatctcgaaggctggcatcgtcacctccctgcaggctcgctgcacggtcattgctgccgccaaccccataggtgcagcaggcaccctgactgctggggctggggtgggacacagggaggtcccgcctgcttgaattgggagcccacggggtccccaggagccgatctgaggaagtcattgtgcagcagagggttcccctcttctgcatatcctgccagagtggggaacagtgaaagtgggacctgggacacctgggtttcctgttgagtcatgt

SEQ ID NO: 13666 - DNA, 1193 bp, Homo sapiens
gcacagcttgtacagcagagatttgaagccccttaatcggcctctccacccctggatattttcctcccataaatggaggtgatggtgtctgaaagtgcactgtaactggggcgctctggaaacagcctgttctcacaccactgatggctcactggacacttcctccttgcaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaacgctggtatctgttggcttccattccgctttagtaagtaacctggacttccgctgaaggccctttccaccttctccgttcagagttctgtaggaggtaggtcgggttaaaaaagctgttttgtttgtggatgtagagaaagcaaaaatgatatagatatccccattgaacttggtttgcagtcactgcctctgtgatatctaagtggaatccatggaaatcctagttagacgtgtataggactagag

SEQ ID NO: 13667 - DNA, 1256 bp, Homo sapiens
ccttcctcccccttgacctggtgctgactgactgcttccacctcccctgggctggcgccgggctgctgtactcccgtagcctccctgggccgctccctgacatcccgtgccactcaagagttagtgcatagtgtcaacgctgagtgggttcacagcacttccaggtgcagcctggaggcctcctttgggctgcccccgcctcagtggggctgcattagcattggcgactcccctcgctcaccttccgcatcccatcagttgctgtatcccgcgactcctgcctcctagaattgtgtgccctccacaccatcaggaggcctgcagcagctttttcccgggctccctgcttctaacagggccagcttcttcctgcagtagagagctctggtgggagtgaaggctccatcacctcctctcccaaacgctgaaaggccaaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtgaatgtgcgggacaagtgggacagcacccccttgtgagtgctggagagaggggtggggagggtgggggttggtgcaccccttcagcactgaggactgcctcctgtacttccttcctcccttcaggtactatgcctgcttgtgtgggcacgaggagctggtactctaccttctggccaatggtgagagcagggagcccggctcacgggtgtgcgtgggtgcatgcatgtgtgcgtgtgggtgcatgcatgcgtgcgtgcattcaaaggccttgatacacatttgcaaagcaccacgattcctctcttaccacccagtcgaatcagcaagtactattattgctactttaaaaccttttctctgtccaccttgcccatctctacttctacgacctgggcccagtcatcagcatttctccccggacacggtgcctgcctctctcttgccattgcagccaagttgatcttttcacaatgaatctgatcggctaaaaatcctccagcaagttcccat

SEQ ID NO: 13668 - DNA, 1135 bp, Homo sapiens
actgcatttgattaactcatttaaaaaatatagttcaattaaattccaaatcagttggaagtgtagctcattttaacataatgggaagtagaggcttattcacaactagatacaattgtacaggctccttttccagactctggaaattatttgaatgttatcctttttttattaactgatgaagagacgaacatttcttatctctaaaaccagaatgaatctgtttatggtgaatttaaatgcagcagtctgtttagacaccatgtgacttcctaaacagaataagctgttgcctggcaggctgaacagaatgaattgaattatatactaatcgttgatattttggggttctaaattaaacacagctaggaaactgaaacacattggttttatataaggggtacccagtcaaattttgcgtattcatttttaaaataacgtactacgtttccaagctgatattgactgttttgcttccccgtttcctcaaggcacattgatggagctagggatctctcctattgtcacgtctggccttataatgcaactcttggctggcgccaagataattgaagttggtgacaccccaaaagaccgagctctcttcaacggagcccaaaagtgtaagaaagattgtgaataatctgatgtctatagttggaaaatttgaatttgctataagattttggtatcagtttttctttttttatttattttttatttttttttttttttttgagatggagtcttactctgttgcccaggctggagtgcagtgacgcagtcttggctcactgcaacctccacctcccaggttcaagcaattctgcctcagcttcccgagtagctgggattacaggcacgtgccaccacacccagctaatttttgtatttttagtggagacgggatttcactacataggccatgctggtcttgaactcctgatcttgtgatccacccgcctcggcctcccaaagtgctgggattataggcgtgagccaccatgcccagcccaaacagtattttcttttgtgctgcaacctccttggcctgccaaccctgcaggagctccatgccctgtgttagcgtgagagagcacttctggtagagcagaggtggtgggtgctggggatg

SEQ ID NO: 13669 - DNA, 1574 bp, Homo sapiens
aacttgagaagggatcactttaccccagagctaataattctgtcctctggacccagacctggatggtgagcctagagaggtggcccaaatctgtagttcagctcttgagccatcgagaccccaagtgcctgacattgagtttgggtgctgcaggtgtgacatctccagattgtgtctccggatgctgtcaggagtaggttctactccctgattttctttgaatagaacaaattttccaagtttcacttttactcctcccatgactaaaaagcaagtgaatctaggaaaaggtaaaactaaagaagaagtgtgcttttgttaaaaggcttttgattcatcatgtactttgctgatgtgatggtttagcgcgttctcagccgagccccttggaggtagtatcactgctcttcatctttgttctcccccgtgcctggcgttgaattggtgtttcttaattgtttcttttgttctgtgtagtgacccacttggaaaacacttctttctttcaattctagtatttggcatgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcgttcaaat

SEQ ID NO: 13670 - DNA, 2726 bp, Homo sapiens
ccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtacttgatcatgttctcttgattttaaattagattttattcccaaaaaggccagtgaggcgcaaagcttggttgcagctttgtgtgtgtcaaaggcttggttggggcactcaggcattttgcctggaaaagttcccttctgatggtcatgtcaacctggtgctcacatttgtgataaagtgatatgggtgctgggccacatgtggagctgctgcagggctctgcccgtgaggcagagtgcactggctgtcccgtgagaatgcagaggcctccgctgagccagggcgcctgccaccccgtggaagagtgggaaccttctagcaggagcctagggccccataactcgaagccctttgagcctcagctccagtacccagctggtgattggagaagtcttaacttggttgtgaggctggcctcagacccgacctgtagccaagccagaaggacccagtgttgtgtgggtgggagtggcaggcttgtggctgctcccttagaacgtgtctagaagtctt

SEQ ID NO: 13671 - DNA, 1266 bp, Homo sapiens
gcatggtaaaaaaaactttctggggagagagaggaaggctccctgaggcaagagggtagagatttgctctgctgctgtcctggtgctggcctgagcctttctgagtgagtatccctctgtagaccaggtcactcacctccatcagctagccagtttcaccctttagttcttcttgtgtcttttcacaggaagcccaagacacccataaatgtgaaatgtcacagtcataggccccctggggcttcgaggctgttgtcatgggtgtgcagtgtttgaaactggaccctaagaggggaggccctctggtacctccccaggcatctccttgctggttctgtcacttactctttgcgacaggttgagagttgtttgaacatctggcttgttccgtggctttctttgatttattttcccaggattcttagtgtcctgaagatttggttaggcgaccttattccttaagctcagatggtatagaaggaaaggtggatcatgacattaattcattcaacaaactccgagcaactactgcttgccaggggttgagtttctagtggtcaacaaagcagaagtggcttctgctttcatgtagcttcctgtctagttggggaggcagatggtacagaagtaaataaaacatgcggaattataaattatgtaagtgctaagcaggacaagacaggatgcccagatagggactaatggatgtggggcatctactttagtttggaggccagggaaggcctttctgaagcaataaagctgaagctaaactgtggcacaaaagcccgtccctggaatgttgggaggtgttccagaccaaaggtgtagcacacatgagggtcctgaggctggacatctcctggggctagctacgagtgagagggtatcagctggttttcacacagcagacctggtgttgcaggtatatttggacagatgcatatatctggactctctggaagtcccagttttgctgaaagataagcgtggcacatcctatcattctgaaataggacacggtgagacagaagaaggcaggccagccttctggatatgcctggtctcactatggctatcctattggcctttatccatccttagtcttatttctggtactgtaaccccttatttccatggtagagggatgggctgatgtggaatcagcgttggcaggcaatcctggcagaaagtgaattagacatttttcacaactctgtgattgtgtttggtcattaaacattggcccactggctgcttatgact

SEQ ID NO: 13672 - DNA, 1173 bp, Homo sapiens
taaatgtccacacagaataagtatgtcttcttaaagatgcgggggctttgctagtagagtttaggcaagaatgctctgcattagaaactgagattgtagaggcgtgcttccaggtacatctgcagatactttttggtcactattatttcttgcatctcttcagaaggctgagatgtatttattggtcttcttcaaggaggtcttttattcagaagcctaggggccaggatcactgctgcctccttagggagtgctctgaaagtggaggttaatatctaagagagccctttaaaattctgatgtccaatgcagggacatttcccccagacggggaaatttggggcctccattgcatcatgtgccatgtgctagtacagtggtgctgtcttctaggcttggttgatgtggggagagaagaggatgctcactgcacttggtactgtgccaggtgcttcatggacgtgctttgtgtccatgttgctgatctctgtaactgtgatgggacttattttccatttcaggttccgaggtgcaccgattatacccgtggcggccaagccggggggaccagaggcccccgaaactgaagctccacagggcattccagagctcattgaggtactgtcatcttgaatccaggttgccctttagccccagcgctgctcaggccagcccctttgtgtccctctctcccctgagagagaaagagaggcagccctagcaagaggactcagttggttccattaacctccctgttaacaccttagcacaactcccccacctccctcaaaaaggtagacccaaactaggactcctaaggttcactgaagcccatgattcaccctccagccataaactctgcagagctcgtcacaccttgctgtgcctcactttctcctttctcttgtcatacctacactcagacaaagcagctcccacccatctggaaccctgggaccgtgacatccattccagtccttcagactgtatcagctcctccagtaccccacctgggctgggggccagtgaggcaggggtgaaagacatgagcccaacagcaggggcaatgcagcttccatcctgggcacctccaccaaagatgggaggcttatcttcggaagctgtggggctgaggcccaggttgttcttcctaacttgtgctggtagtcaggg

SEQ ID NO: 13673 - DNA, 1240 bp, Homo sapiens
agcctgtccagaggaggtattgctgcagtacaggcgaggctcagccagctggtaaaactctaggcctgctggcggctggcttctggcatacgtcagggagtggcggaagatgaggcctaaaaggtacctaggggctagatgatgaggagttttaaattctgaaggcatcaggaggctggggaaatgcatgaggccagggagcaatgcgacagggtgtcctttagtggctactctcctgcagcatggagggcctggcaggacagaccattgtagcagtcccacgggagaagacagacgaggcttctccaggtgccctttccttcagactgagcggaaagagctgagagcatggcagaagcttggaatgcagtcagggagttaggtggttttgatctcctgtccaccttgccagggcatggacctctgagctgagttcaccttggcagccttgatgaactgctggtcagccacattctctgccttcctctgccctgccccatctggctcctctccccacggactgtggcaccagtttctcttttctagctcctgacgtcccagatttccatcccaacgagagatccctcgggaccgttcctcatgtctgtggaccactgtttctccatcaaaggccaaggcactgtgatgacagggaccatcctttcaggctccatcagcctcggtgacagtgtggagatccctgccctcaaggtcagtcttaccttgtcttcccttctggcctcctcgctggcagcaagggagggggactgtccctttgtctgttcagctgctgagcctgctgctgtgcctgccctgggactcccactgcctgctccgccccacctcccctctggctgcctggccccgcccggctccaagtctttcaactcagattctaggactgctgctctccctaattctcatagcgcctgtttattggaggcctatgatgtgcctcaaggaggtgttcccaagtaggtcttctgtgtagataaagaaactgaggctccagaaggtgaggtgggcttgagatcacatggttaacaagtggggctgctggaggggaaacctccctttctggacgctgtacgtcagggtggcaagtatgtgtggagttatttctgggtacctttttcttaaccacagtaatttcaaattaaacatgacgtgaatcttatgatgctcagaatcacagaatctggaagaaatccaggttggttttgcactcctggtggccatc

SEQ ID NO: 13674 - DNA, 1676 bp, Homo sapiens
ctcactaaacatttgttgaatgttgaatgaatgtgactataccagtcctcaatgtgacgtacagtaggtgacaatgcctgtcacccccccttcccttgccattgatcttttgcctaattgaatccctggaactgatttgacaagctgcaaggagagaagtgatgttcatagaggagctgctatgtgccaggggcatgataggtgctgccaagtagtttcatactcagtcctcagagtcctagaatggagatgaggcccagggatggtgcagggcttgttcacaagggcgtaagaacggggcttgtgggtggtgaagttggcatttgaagccaggcctatcttcctccatagccagccctgctgccctgggacactgtgctgttggctgcatttgtggctgatacctgtggagctctggggtctgtaggcctgggagatggtggggcctgctgagtggggtgggaggacagctcacaagtcctgccctgctcttgcctcggccaggtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatttgtttttggtctgttgaagatctctcataatttaattcttaattttgggaatagtgcttttatcaagtgctttttattcattaaataatggatttgcttctcagcaggtttgcaaggcaagcatttacattttacatattagaacactgagttattctagtaccagagtgttgaaagtggtgccagagtgttgaaagagttgacgtggcttatgtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagggagccatccgtggcctgccacactcagtcaagtcctgtggtaccctctcgttttc

SEQ ID NO: 13675 - DNA, 1137 bp, Homo sapiens
ctcctgagtagctgagattacaggtgcctgccaccatgcccggctaatttttttttctatttttagtagagatgggatgtcaccatattggtcaggctggtcttgaactcctgacctcgtgatctgcccaccttggcctcccaaagtgctgggattacaggcgtgagccaccaggcccggctggtctgctcatctttatggccctagttttgcccattgctgaacctggtccagattaggtatcagtaggggtttgactttgactttccaagaaggtggcatttcatttttggatggctgctggtggcagatgttctttgggagataaggtcagagtggacccaagcctggatgttgtcacacatggtgcctctccttccttcaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtaagtgtcgggcgtcacagagttgcttggcttggggccctccatgcctcactgctttgtctagggcagacactgggcagctctcttgcttacctgcatgcttgtgggataagactgcatctggccataacttttcatgtggtgccagtccttgtggaggaaaaagggatttttggggtcctggtgtgagctgggtgtggaggaagctctgctagcctcgtcagcactgcgtgcccttgtggccagtattgagagtagctgcatcctctcctggaggccagactgttctaggtcccaggctgcttatgttgtggtaaaatgaacctagactttagaatcaataggtttgaatccaggctctgattcagagtttgtaaacctggccaagtcacctaacttctgtgcctcagtttcctcatctataaaatgggaatgctgttagcccctcataggggttctgagtgtgaaatgagttaatgcatgcaaaatattcagaaccctgtcct

SEQ ID NO: 13676 - DNA, 1152 bp, Homo sapiens
ccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggattcactgggtaggatgtacaggagagctgtgtcaactttgtgactccaaggagtggggccagtactggtgagaacttgggagtggaggattcagagggacagttgttgccccagcagacaagggctttaaaacaaagggctttctggcactggctcccctgtctcaagagagtgggtgttctccatagctgagaagggagcagagtggaggagtgtgaatttagtgatcttgaaaggctccttagccttggaattctctgatcctaaatctggtttattgatgtagttggttggaggctatattttattcccatcttcttccaggaacattgaaattgatagtccctatgaaatcagccgtgccccagatgagctgcactacacctatctggacacatttggccgccctgtgattgttgcctacaagaaaaatctggtagaacagcacattcaggacattgtggtgagtggctccactgtttgccttccatggcgtcttccccagacagtgggctctgggggccaagaactcaccttctgtccctccttgggctggagtcatttgagctcatggcgtcttctggtcttggggtggggcagcaggtcgagtgggccagcctgggtgagtctaggctcccatgtccctacagccccgatgaagcctgtcctcttgcttctcccaggtccactacacgttcaacaaggtgctcatgctgcaggagcccctgctggtggtggcggccttctacatcctgttcttcaccgttatcatctatgttcggctggacttctccatcaccaaggtaccgtctctgccttcttcctgcttgtcatttgtgtccttggtaatatttcaccagcttgagcactgatcctcacagtgagcccagggcaggacgccatggccaaaagacccctgcctgtgctc

SEQ ID NO: 13677 - DNA, 1203 bp, Homo sapiens
agtagtcccagctactcgggaggctgaggcaatagaatctcttgaacctgggaggtggaagttgcagtgagctgagatcatgccactgcactccagcctgggcgacagagcaacactctgtctcaaaaaaagaaaaaaataatttaagtcttctaagacagatatgtagctgtttctctcagggctgtttataaatagcaagagtgtaaaacagtgtaaatgttcaacaatggaacaaaagttaaaaacattctaataggtaatcccagctattcgggaggttgaggcaggagaatcgcttgaacccaagaggtggaggttgtggtgagccgagatcgcaccattgcactccagcctgagtgatagagtgagactccatctcaaaaaggaaaaggtgatctcttaaagataattgcttttgtctttggttcaaaattttgttgtgactttgaactgctactactgttttcagtatcctcagtctctcttacttctcttgccttgttcttcctttagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggtaagctcaggtggagtccagcccatccctgtctgcttcagagaatgtcttgcagagtgactactggttgataggcttgggtggtgtggggtggatgaaatctgcagtcatttctaaggtcatcccaaaagtgtttaacctgcagtgaaatgactccatgggggtcttgtttctccttgggggatcacaggtagaggctaggggtagcatttggagaggtggaatgggtgttggagatggaagcaaggcattccacgcagaggcagtaagagggacaaaggctttgagatggtgtggctgggcagatactggggtagcaaagctgttggagtggttgagggccttccttgaatgttgggccttggttggaacttgaagag

SEQ ID NO: 13678 - DNA, 1221 bp, Homo sapiens
tgggcgcagtggctcacgcttgtaatccagcacttcgggaggccgaggtgggcggatcacgaggtcaggagatggaggccacagtgaaaccccatctctactaaaaatataaaaaaaaattagccgggcgtggtggcgggcgcctgtagtcccagccacccgggaggctgaggcaggagaatggtgtgaacccgggaggcggagcttgcagtgagctgagatcgtgccactgcactccagcctgggcgacagagcgagactccgtctcaaaaaaaaaaaaaaaaaaaaaaaaaaaaaaaaaaaaaagtaagtacactcgcactacgaacagaaggatatcccgagcagctctgagagggctttagcaatcaggcgccgggtcggcttcccggttgccccggagacagggtccttccttgttcggcgccgccatcttgtgtcaccagcccttgcccaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtgagtgtgggcgacccctcgccgccgctcccgggacccttcccgcctcccttcctggcggtcccccgactccgcccgcgcccctctaggcctcaggaaatgcggagacccgggcggcgggcggggcacagggggtccgtgggattgcctcggggcccgcgaggagtcctgggtggccaggggccccggcgcctccgctgcccccggtgcgcgcccgccctcctgcctgggccacgtcagcaccggcctgcccccgcgcgggtcgctgctcacgtgggcagctgctgggatccgcggccgaccagcctcggagcttgcccctgtttgggccgttctcggcaccgctcgggagacctcgggccggtagaacgcacctcccttccgtaaggcgagcgcggcagcccctcggcccggtgccagcgggc

SEQ ID NO: 13679 - DNA, 2106 bp, Homo sapiens
tgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgatcatctgcctttgccagagtctttttttccttcttcaagagccttggctcagtagagaccacatgagctaatcatagtcaatgccttatcaagcaagagagccctccataaatgggcacgtgtggtgcttcaaggcagaaaggccctctcatatctggtcctgtagtgcctgtccctagtttttttttgtttgtttttttttccgggggcgggggtgggtgtattttaatcacattgttggaggttgaggaccatggatggagaacgcattgtccctttaggagagcagccagaaactgctggggactctgagccatgcatatcctgtaggtgtaactgtaacctagtcatgtgttatgtgttttatttttagttgacctagttgctaacacttagatgtgtaattctgcatttgtcacaggagaggaagatttggcagcagaggccctgtattccaacatatgtaagcccccacctggaatggaatagttgccacttagaagcaattttattaaaatagtagtagttcag

SEQ ID NO: 13680 - DNA, 1204 bp, Homo sapiens
tgcaaccttgaactcctaaggctcaatagatcctcccacttcagcatccccagtagctgggactacaggcacgccctgccacacccagccaagattctttttttaatctacctttgtactcaaaagctgtactaagaggtctaacaggcatttgagattaatagatcccaaactgagttcctggttcccacccaatcctgctccttccaccagccttctttatcatagataatggtggctctgttgttccacctgttcaaacagaacacctggagtcaccttgtactcttattctcctagtccacttctaattccacagaagatctggttttctctacttttaggttcttagaatctgaccacttttaggcccttctgctgctactttggatcaggccagtgtcatctctcacagccttactgggattagagcagaaacatgggacatgatgcttagaatctcagattgtgtaggccagtggttgtcaccctgccctaagctggacccaagctattcatggagtgtcctggaactgctgcagggatgggtgggaagttgagtgggtgggatttgggtgcctgttttccctatcagcagtctcagtcagagccgcctgcttctgtctgttttacatatttggtttctgcactagatttctttgaataacaggttccacttttttagataatttacaaactgtttattgcaattgaactctcctcccctaaggcattgacctgatttgataacatcaggatctttctcccacgcccctgcaatctctcctgtgtggcaggttttctgtggttgtacctgaaggccaattagttgccaggcagtcttatctggcctgcccactggtaccagaatgatctctaacacagcccattgcacaagacccaagtgtcagtgagcctctgtgttcagtgaaggagactgagctttgatataaaaggctgcagagtgatggagccatcagcttgtttttttttttttttcttgttttttttttccttgagacagtgtcttactctgttgcccaccctggagtgcagtggtgcaatcacagctcactgcagcctcaacctccccaggctcaggggatcctcccacctcagcctcctgagtagctggaactacaggcgtgtgcaaccacgcccaggctggttttgaactcctgggctttaagcaatccccctgcgt

SEQ ID NO: 13681 - DNA, 1245 bp, Homo sapiens
acagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacc

SEQ ID NO: 13682 - DNA, 1245 bp, Homo sapiens; identical to SEQ ID NO: 13681

SEQ ID NO: 13683 - DNA, 1223 bp, Homo sapiens
cagggtgtggggtccaaaaagggcaggaccctctgctctaggccattctatcgttcaaatgtttccaatgggagggagttaggactcttggagactattctgcgtatttaaatcagactccttgatggacttctcccacggggacttcctcctggctgggtctggcaggggttgaggggctttgctgaggagtgagccctgcactcttaatttccacagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaaggga

SEQ ID NO: 13684 - DNA, 1223 bp, Homo sapiens; identical to SEQ ID NO: 13683

SEQ ID NO: 13685 - DNA, 1101 bp, Homo sapiens
ctttcaattaatcccttaggcataattcttagccctatagtccttgccaaaaatttttcccatatagcaatacattgctttcctgaaaacgctaaaccatcatagaatgctgccatccctgggtgcgtatcccagcctcattgtgtctttgctggccttagttgctgtttccccatctctcttaagagcttgttatttcagtagttttataaatggaactgctgggttgtttcagggttgtttatatttttttggttgctaatgagaatgaagttattttcaaggattttttttttcttacgctagtgggaactctgtttataattcttgtcctttcatttatttgggtggtttttcttatcaatttagatgagtgtttttatgtagtatacctttgtaggtgttgacattcattttaaggatatgatactaagtgtacgtgttagaggtgttgacattcatttttatggaatgatattgttaacctttttgttttctagctggtttaggtgaatttcgaattcgtgacctgaatgatgaaattaacaagctgctaagggagaaaggacactgggaggtccggataaaggagctgggaggtcctgattatggagtgagtacatggcagccccagtggcgggtcttgtctagttttccacccacagcagttcccagctcattcttgccatagtagtcgcttgatacaggaaagctatgaacaggatgggtaggatgatgctggaagacctcacagcacatgcatcacagcagacggggcatctgtatgtaccagccagaaggccttgtggaagctgcttcatctctcggcctcgtgtttaaaatgaccatgagcccgggcatggtagctcactcctataatcccagcactttgggaggccgaggcgggcagatcacttgaggtcaggagttcaagtcaagcctggccagtatggcaaaagcccatcttttctaaaaatacaaaaattagctgtgtgtggtggtgcacgcctgtaatcccagctacttgggaggctgaggcaggagaatcacttgaacctggaagatggaggttgcagtgagccaagatcgccactgcactcc

SEQ ID NO: 13686 - DNA, 1101 bp, Homo sapiens; identical to SEQ ID NO: 13685

SEQ ID NO: 13687 - DNA, 1736 bp, Homo sapiens
taagaccaattttcagcatatgtaactggcagtctatctgtatataattctgtattctgccctgatatcctgtggcttatggtacctgggcagttttcacaactggacttttttaatatataaaagtaagagtgttataatttgaaacttccagagacttcatagaaagctctgtaatatacataaatcttttatcatgtaaccagaaatctttgcctgtttgtgacatgtaagtgtataatttgataaatgttgttgtgtacatatctgtgaaaccttaggggttaattgcatgaaaacaaagatcaggcgttttgttctgcatggtgactgttgctttggtagacagtttttttctgaggcccattgtgaaaacttttaatttcttttttaggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacc

SEQ ID NO: 13688 - DNA, 1188 bp, Homo sapiens
ttatttctcttaatggattttcattgaccctaaccctgtaaattccatcacttttatcaaggtgtatattataataagtctataatacccaatcatgtagttgtgtgattattttatttttttgagacagagtctcaatgttgcccaggctggagtacagtggcaccatctcagctcactgtaagctccgcctcctgggttcacaccattctcctgcctcagcctcccaagtagctgggattacaggcgcctgccacttcaccgggctaattttttgtatttttcgtagagacggggtttcaccatgttagccaagatggtctcgatctcatgatccacccacctcggcctcccaaagtgatgggattactggcgtgagccaccatgcccagctatttttttaaccaatatattagctagcttttttccccagaataattttccaaaaatacatttaatagagaataaaagttaaaagaactttcagtggtttaatgctgttacttttaatatttcaaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagacatttgttatcgctgtggtgagtctggtcatcttgccaaggattgtgatcttcaggaggatggtaagtatttaacacttccttttcatacccctctagagcttggagaggtgagcacatgcaactgtgtatagcatttccacctttgaggttttgtattgtataatttaaaacgtaacactttgtaaaggttttatagtcttggcctgtttcttttccttattgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaag

SEQ ID NO: 13689 - DNA, 1233 bp, Homo sapiens
ctggtctcaaactcttgacctcaggtgatccacccaccttggcctcccaaagtgctgggattacagacgtgagccactgcgcccggcctccatctgtcacccaggctggagtgtggtggtgtgatcacggctcactgcagcctcaacctcctgggatcaagcaatcgtctcacctcagacccccaagcagctggaattataggcatgcaccaccatgcccaactaatttttctattttttgtagtgatggggtctctccatgatgcccaggctgatttcgaattcctgagctcaagtggtccacccacctcagcctctcaaagtgctgggattataggtgtgagccactgcacctgaccagccttttgtttgacaggaaagagtgatagaggcccagagaaccaagtgccctgtctccaagttctgtgtttggacaactgtccttggtccagctcaggtcttcaactcttttctggagagagcaggctccttgcttagctcagcttctctctgcagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtaggtctgagccagggctgaacttggaaacttagcttacccttgaataaatgtcccagcaaagggacctgagcctccagtggggatttgtgcactcagtgttcttgctgcacaagctgtttttcataatattgtaggcaggaccttacatgtcatctagttgaacagttctttgttttttgttttgtttttttttttgagatggaatctcgctctgtcaccaggctggaatgcagtggcgcaatctcagctcactgcaacctccgcctcccgggttcaagcgattctcctgcctcagcctcccgagtaggtgggactacaggtgtgtgccatcatgcccagctaatttttgtatttttagtagagatgggatttcaccatgtaggccaggattgtctcgatctcttgacctcatcatctgcccgcctcggcctcccaaaagtgctgggattacaggcgtgagccaccgtgct

SEQ ID NO: 13690 - DNA, 1239 bp, Homo sapiens
agacagtgactttcacagtgaaatccctcactcagggatttcagcccagctctcctgcccgtttcactacaccagagctgccttcatgggttgctgcaaatgccatccttagcctgccctgtacagtcccttctgctgtatatatctgtacttctctcttcccttctaggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaatgattgctacttctgcagactcatgcttcagggctccaccttccccttcaaggcctcccctaaagaggcagaacacctgccctgtcccccttgcacccacagccctttggctgttgtagtcctgtgaggcaggaccctctccccgtcatcgctgtcccagcaccaagcccaggggtgggagcggtagagggtggttgagtgaatcagctaacaggcagagttcacactccctcccgttcgtgcttcttcacaacgcatcctcctttgatagtcgataaatggaggctccaaagggcttgggtcctgtgtctgatcgttccagcatctggtcttacatggagtgtgccctggggtttctgctccctgttcagttcagcgaatcagcataggcgaacagccctctagagcattctctgttggttgcagatgaagaatctccggtttaggtcccaaggggagcaggcttttaaactcaagccaggctattttaccaactttgaggccaaagtacacccgaaagggctgttttaaaaatctgggcctcacccttagagattcagctgaggggctggggcaggaaaggcttattc

SEQ ID NO: 13691 - DNA, 1165 bp, Homo sapiens
ccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaata

SEQ ID NO: 13692 - DNA, 1677 bp, Homo sapiens
aatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggccttctgctggggctcctggatgacctgagtaggagccagggagctgaggaaaagcggcagcaccctggtcggcgggcagcctgggtcagagagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatcacggagctctgtggttgctgttctgtcgcagctggcatgggattcttctttcgcattgagagggatatttaaaaggggatgggactagagttctcagctctgctgcagagggaatcagggaccctgggaggatgacaagtcctctctactgtccccatttcagaacacacttgggaggtggatggggttctggagcccatttgactcctggggagactaaggcctggagagaaggaagggcttgcccaaagacacacagctggctgaggtggagccatgggtctgagaggccagctcagggatttgccttgagtttgcctgatttgggaggcgggggtggtggtgagaggggaggtttgaggggaggactagtctggctcaggtctgtaatcttcatggttctgttgacagcttgtgtcaccaaacagcctgttaatgaacaggaacaaggag

SEQ ID NO: 13693 - DNA, 1208 bp, Homo sapiens
atgataaaaattgaaattgagaagatgcatagtgtgcttatatatagatatttacaaatcatgtgaattcctatgggctactgatgtggacttggggaaaatgctggtaaaggtcaatgatttaaagatttagaaagtataattaagtggcaagtggcatcattagttgcataaattttcttatcaaaataaatattttggaattgtttaatgttcaaacggtttttgtgatataccagcacaactttaaaaacagtgaaaagttgatcataaactgctgtattttatgatagaatctgtctttgtaagtggtgtattatacttagagtaacgtattttatttaataaatcacagaaaagatgtcaaattttgtagttcagggatttcagaggtagcaggtacccctgtgccttcattttcaggtaactgctgtgccttctcagatcctggagaagggccccaggggctgcctttctgaagctatttaagcaacacttaattgccaaattgatgtctcagtaaataatatctgtcatggtccagtagaccactctttattggcaactattggtactttcaaatattttagttcttatgattgttttcaagctggttgttggttattataacaggggatgatggggacattgtatttgtaaactacagtttatgatacactcctttgcttttccttaggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccaggtaccatatgctcaggaatgaatcagttcattaattcaaatcaacaaatgtttattgagtgtttactctataataaccactgttttgggtaccaggcatacagcaacaataaatggacaaaaatccttcttctgtggagtttaccttctagtggaaagtgagagacaatgaaagtataagtaaaacagctaatgtgttagatggttaaaaaaaattgtggtaaaaaatacagcaggaaaggaagctaggaaatgcagtagaggtggggtagggtagaattttaaataaattaaccagagaatgcctcacagggaaaatgacatttgaggaaggacttgaaaaaag

SEQ ID NO: 13694 - DNA, 1159 bp, Homo sapiens
gaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacct

SEQ ID NO: 13695 - DNA, 1943 bp, Homo sapiens
gttgcagtgagctgagatcatgccactgcattccagcctgggtgacagagcaagacttcatctcagaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcatacctt

SEQ ID NO: 13696 - DNA, 1289 bp, Homo sapiens
caaaaatgctagtttgtcaggtcattatatttgaaaatgaatccatataaatgaaattcaagtagtaattttagaatgtgatttcatcctgtgggcaatcctagagattcttacaagttaagatacaaagtaacaattggtgattttatccttatagcttcttgagtttctgttactggattagtcaaattttttagaattaaaggaaagcattgactgagttctttttactctatttatgtaacagttgtgttattcacattagaaaatgtagtagcgagtatttctttgattatgaataatagctgaaaagtctacctttaaagaacttaattggtttcactaagatttttgccttctctcaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcggtcctgtttacatttttgttgggagaggtgattactttttagttttatcactcaattataagatcagtgtgttttggttttgttttgttttgttctgtttaggcagggttttgctgtgttgcccaggctggagtgcagtgcagtggtgcgatcttggctcactgcagccacgaccttctgagctcaagtgatccttccacctcagcctcccatgtatctgggactataggtgcccaccaccatgcctggctaatatttg

SEQ ID NO: 13697 - DNA, 1252 bp, Homo sapiens
taattcacaatttatgttgaagtgtaagcggattttcatttcttaaaactttgatactaataccaatttgcatagttttattcttaagtaatgcaaatgttttaaactgaagtgtaattataagtacaaagaaattttaattgaaattatagtctcttaacttctaagaaattaccagttaagtttatgaaaacaaactggaacattaaaagattttttaatatagcagactttatttctgatatagaataatctgtttattaaaaagaccttgacagaataattgtaaaaccagaggttgttttttcctcagaatatatttaagtaaaaattcttaagtgatctctttgtaatatagttttgcccttttaatcaattggaattcaggttccttgaacacaaaatgctgaaaagaccaagtaataccagtcgtatcacttatttccaaggactccaaacattcttttcttcgaggaccttgtaggtggtagtacctattgggaaaggtactattgggataggttttaggttatgaaaaatgtttagattacgaaaaaaatgttttcctcttccagaaaaatgttaaggatctcatggattcaaatggaataagaatccttgtggacttgcttacccttgcacatctccatgtaagccgagctacagtaccactgcaagtacgtatccttgtttacgttttacaaatttaacgttctttgagtataattttagaggcaaaagaatcatagaaatctgaaaagatgtggtcacacacttatttttccagtaattacagtagtactagttctgagatttcacacagaagatgtgaaaccactgtaagaacgatccaaaatggacagtaacgattgagttttattttgtcaattaaagtaactgtatctctaatatggcttatcttgaggcaatgtgacttttaggatataaattgaattcattagatatgtaaatagtacttttaacattggcaagcagtaagaatatgctttgccttaaaggagtctggacaccttcttgataccagccaagaggactgatacttaacttatagaagaatctatccttagctcatttgatgtttttggtgttttaatttcctgatgtaaggagatgtgtcatgttagatttcgtgtgaattgtgaccgaaagtgctatttgagtatttagtatatgatgtattctgttatataccattacaacaggtactgttctggtacacatacaatacatt

SEQ ID NO: 13698 - DNA, 1238 bp, Homo sapiens
tcataaggataacacttgcatgtaactttttaatctttatgaaataattacatataaatcattttgattcattactgtactaaagatatcttgtgatggaaattactgagaaactgtaacattttaaaacacttgaagttttcatggttccagttggactcaaaattatacagttagtatttagaaataaggtagcattaaaattaaagctatacttggaaaataccaaacatagttaaatcaaggtttaaatttatgtaacaaagtttgataagccctttgggggaaaatacccactgacagtgtgttgaacaacaccaagtttaatcaattaaataataaataagagtctttggctcttctagggtactgtttttcaaggaaatcttatggaaggaaatgaagtcatattaagcagccaaatagatttaaaccaaaatacctaatcatgttcccagctgtatgagagcttagtcttcattaacaaaaaagtaaggtaacctgcttcatgcctagtagaatgtcgtatgctctgaacatacaaattttaacaaatatattaaatgttgacgtgagaaaatgttttctagggatcaagacaatgccatcattcggcctctacccaaagtgaaaagactgctgtcagatagcacttgccttccccatattattcaggtgagttatgtaatcaaactaggagcaattttaagaatcattttctctgaattttattatcagtaccagtctttgttttgttgcagtctattccattttcaaaaagcctaaataggccaggtgtggagtctcacacctccaatcccagcactttgggaggctgaggcgggagggttgcttgagtcaaggagttcgagaccactttggtcaacataggaagaccccatctctacaaaaaataaataaataaataaagtaaatggccgccaggcatgatggcacatgtctgtagtccctgccccttgggaggctgaggtgggaggattgtttgatcccaggagtttgaggctgcagtgagctgtgatcatgccaccgcactccagcctgggcaacagagcaagaccttgtctcaaaaagaaaaggaaaaggcctgtactttgaattacattcatttcacttaattttttatttttttttatttttttgagacagtcttgctctgttgcccaggctgaagtgcagtggcaggatcttgacccaatccaaccttcgcctcccatgtt

SEQ ID NO: 13699 - DNA, 1183 bp, Homo sapiens
ctctctatcattaagacttcagactaaattatcttacactgtttgctaaggtacattgttactgttcttgttgttttcatctcagcctaatactttgcagcctctaccttatttgccaacactttattcctttggcaacctgtctgtcattcccatttgactctagaagagttaagtccagtaacctatacttgcatataatatggtagtgactgggtgagaggcacacaggctttgtccagaaggatgcaattatgtcttagaatggaacccggtcttacaactgctacttcctactttttccctcaagacagtagcaccaggtaaaaatcttagatgcctgattagagtgtcctctgggtgtcaggaaatcagatttttggatgtgcagtgcacaatgaggtaggaagacagggttttatagtggttatgaatatggactttggaggcagacctgcatacaaaactcaactataccacttattagctgtgagaccttgggccggttaaactgggcatcagcttcctcactcataacatggccatgaaaatacctgtctcactggttattatgaggattaaatatgacatcctgtgtagaacatctagttaagtgcctggcacagagctggtgccaagtaaatataagctaacctgatgatgcattccttgaaatgtcttttactctgcaggtcgtcagcttgttctggaaactctttatgctttgacatcgagtacaaaaataatcaaagaagcaatggcaaagggtaatgtatagagtgctttcttagctagtcatgtgcaatataatgaagcttattttgagctgcattttacagcctgataaactagaagaatgctttggaatgtttacagtttttaaaaactacattcagttgaaatatggttgaaaatgaattctgattagaaaagtcaaattctttataagcactaattatctttttccttcataggtgctttgatctatttactggatatgttctgcaattcaacacatccacaggttcgagcccaaacagcagaactttttgccaaaatgacagcagataaactgataggtccaaaggtaggcacaaaataagttcttgaaaggaaattaattattaaagcattgttactttgatactgatttcaagaagtttactgaaatctgagatggtga

SEQ ID NO: 13700 - DNA, 1217 bp, Homo sapiens
attttgaaatgatttctagtctatagtgtaggcaaacatgaaaatagtactatgtagctgtttattaaggtatagatgtaatttaggtaattgaaatagatgattagttttgtgtgatggagtgcctgagcaggttctgacatttttataaaggtcaatgttttcacttgactgctttctagaggtgtgtgtttacctttctctcttgcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgagatatatttgttctagtttaatctttccgtttgaagacctcatatatctatctttatttctaagacagatgtagtattaaacagacgttatcttacattcgtaactcttcatatagatggctgcattaacataatctaatcattcctaact

SEQ ID NO: 13701 - DNA, 1159 bp, Homo sapiens
cgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacaggtatggatgtcagcctttgcctccagcggaaaaaaatttgtacattgagttttccttcctttggccctgggtggtttcctaagtttctcccaccctgattgcttttcctgcagtcagtggacgcaccctacaggcatgagctgctattgccggccctccgaattcgatgctgggggcttcccaattggagggcggtaatggaagcgcaataacgttcaccattctactatccaaaggaatctttgttaaaggatggatttatgtcccttgaggattcaccaaggcaattaaggctacaaattctgagaaatagatgccttcttttgtgatacagccattagatctttttctgagaagctggtgtaattccgtttgattggccgtattccgggaggctgagttaatgacaccagatggaggatccgaattcgagtactagcttttccacttaggaggtcacagcaccactttgggcctcaggtttttt

SEQ ID NO: 13702 - DNA, 1179 bp, Homo sapiens
ctttgacccttaacatttaagtagtagtcgcaatcttggctgcaaatcagaatacatagcttttaaaaaccaatcttgtttcatatgctacacttgggagagtttttttaaacggtgcctgggtaatttagtttcatctggtaaaaaccagcctgtaagcatcctcctctttgaaacgattagtaatgattatattttggtgtttattttctgtgatgatgtatgtctatttgtattactaatacctaaaagactgtaagctttaaaacatatttttctttgttttaagccgcttgatggcattgaaacgaatgggaattgtaagcgactatgaggtatgataaaccctttccaagtttttgtaagattaattcagtaaattaaaataacttctggtgacatatttgatgaagagctattaaccaacatatactattttatatttcacagaaaatccgtacctttgccgtagcaatagtaggtgttggtggagtaggtagtgtgactgctgaaatgctgacaagatgtggcattggtaaggtaaaaacatttctctttgcctgtcatatagggaactactcactcctggagtaaatcaggtacaagttaggattttttttctttaccagtggcttattgacttgcagtgtattaatctagattgttctttctactcgggttgagacatatccccacccaaacaaaaggtgatattagacaaagattgtctaattgtgtttagaaacgtttttgtttgaagtaatatgcaaacaatttggacttaggtgttttagatatagaaacttaggaaacaaggctgttaatttgataaagtgtgtgaaacactgaaacatctaacaaatattttattaaacatataccaggcagaatagaaaacatgtacctttcctactcttgattttgaactagagaatgctctggatggatttttaaaaattggtactcttttacttttttctaaaattcatttagattatgggttagaaagaagtaactttcttgtaccagaattcagtctaccaatcttagatttataaagccagagtctatgatgttagatacataatggttgaatgaataagctttccacaattatatatcctttaatttgttgttctggtaaaggaagcattctcccacagtttaccaatgctttct

SEQ ID NO: 13703 - DNA, 1239 bp, Homo sapiens
ttaaagaaaatttactttataaccttgttgagcatggtcaaaacttgctgattatatattcctaagcatcaagaattctatatggttcttttttcactgtatttcccttatttgtcaatagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagact

SEQ ID NO: 13704 - DNA, 1231 bp, Homo sapiens
tgtctaattcattttgtggtgtcacattcattgggcaatttatatttcttttcatgtccctgaagtaatgttttatttttagatagttctaaccctgaggacattccaaagacaatggtatttctgtttttttaaaataaaggaatacataattttttaaaagcacattttgctaagggactttcaaagggacaggacagtcatgtaattggggggtgaaggtgattctgttcacttttattctattgttttcccctttctcctccataggggctagtcctgagataaagtaaaaaaaaaaggcatatggtaatccattctgaatatgtcatattcccttagtgttcatagctgagaccttccataaactatttcttaagacactgaagatgaatctcttgacacggttatagggagcagagataaggcatccaaggggttgcttttcagctaggaagtttttggtcatctgtacaatgcataccccagtatcataaatgataagattttattttcaaccattctttttcttgaattaaaaaaaaaaacagtgattaggaaattttcaactagaggaaaccaaagaacagcatcataaaccatgtgtattcagcttcaacatttacccacattcttttaatcctactaccagacttgcctatctgaatcatgaatgttaggccctctggtcaactagattttcttcaatgcttgatttttcccttcaaacagacttctgttactgtcactagaacaatcagtattagacttattccagccactcttcccttctctctcccactctagagaagaaatggcctcaaatttagtttggagtagggtgctgtgcacatatctcattaggaaatggtgtagatattcaggttctatctaaagatagttcataggagaaaaggggaggcaaagagaggtgattcatgtgctggaatgatgaaggtaccagcgctgctccttgaaggattattagcttttggatgggtgatggaattaaaaattattaattgtaatggcaacaatagctaatatttgacgtgtttactatggtccaggcactgttccaagcacttcacatatattacgtcattactatatgcaaaggtgaggaacaagaactattaacatcccatttgcaaatgagatggaacctgaggtacaaggaagttaattccttcaagggcacacagcacagggagatagaagttcaaatatt

SEQ ID NO: 13705 - DNA, 2669 bp, Homo sapiens
tagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaatggttattttaaagccttattctgtctttgaaaatggtgagttgaggtcacacctctcttgctgtgggaaggtgaagatgctctaaactcaggggtgtacttttttttttttttgagacagttgctctgtcgcccaggctggagtgcagtgatgtgatcttggctcactgcaacctccgcctccctggttcaagcgattctcctgcctcagcctcctgaatagctgggattacaggcgtgcaccaccacacccagctaacttttgtatttttagtagagacggggtt

SEQ ID NO: 13706 - DNA, 1149 bp, Homo sapiens
acgtatttcttgatggcctactatgtgccagataccatggattcacgtttcagtgttctggccagagataattatactgtggcaaaagtaaagtttataagatttattgacaaaactaagtctacagataaaatcatgcattatctgtattattttgttattttccaaatgatttcaccactgattgttttttatttgtagggagcatttagtgggtggaaggttattttacatgtggatcagtctcgagaagcaggcttcaaacgccttcttcagtcaggaggagcaaaggtttgtatcaaattaatttactgacctttttacatgaataatcatctaaccaagattgctatgatgagttcttcattttctctactttttgaaatggtaatccttaagtacacattatacagctgaactactttggaatactggtagattgtgatactaccttgttttttcattaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggtttgtgagattctatccttgacctcctcattaccagagatacgtttatgtgcatagataagtaactgcacaacaaaaccttcagctcatgattagtagaagattagtctcctgttattctcttctattccagccctttcagttttattctatttgtgttttttattataatgaacatattatgtaaacatttagcttggaagttaaatatgagaagagtataaaaatctaggtacctctaaaggctttaaaaataccctttaaaatgttggaatataaagcagaaatcgattccaggagtccaaggagaaacatttatccaaaggtcctttagttttcttgactgtttgctttcatgtacattaaatacctatgttagacactgtggtaaatttaagcatttgctatatggtgggcttactactctcatattcagaattggcctgtgttgtgtaatttgaatggggtaagaaaaatcttctgacaccagagtgcccaaaaggccatcaggagtcagcag

SEQ ID NO: 13707 - DNA, 1194 bp, Homo sapiens
gcatatcccaaatatgtctccatgtcagcaactctcattcccaatgtgattacttcatcagcacacctccctagcatggcaacagaataatgatatttttgttggtattttgccaaaaatcattgcttttacttgtatagaataatggaaagattaaaaagttcatttatctaataggcaaccaaattacctttgggtttttaagtagagattcagacttatcattttggaaaatatactatgaccagcaagggctagagttaaggaaatatatatttttcccttaaaatggttttgagagactgtatctgaaacaattactttgttttagagacatgttattgaactaggtgaacaattagtgtaattctgttttggtggttctcctttgtaaaaaaaagattataaatcctaaaaaatgagggaagcaatagtgatatttgtgttgtttttcattattcttctggtaaatttaatatgttcttttttaaccatttgattcccacagaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtaaaactgtgtttcacaaagggacaaatgaaacattttctctagtatttaatattttatttttatttatttatttatttattttgagacagagtcttgctctattgcccaggctggagggcagtggcacaatctcagctcactgcaacctctgcctcccttgatcaagcgattctcccaactcagcttcccgagtagcgggattacaggcacctgccaccacgcctgaataactttttatttttagtagagacgggctttcaccatgttggccagactggtctctaactgacctcaattgatcttcccacctcaacctcccaaagtcctgggattacaggcatgagccaccgtgcccagccactaatatttaatattttaaaatctttacagaacagcttttacttctgacatgtcattaatctagtttgatactgttttctctaacatcttgcaaagatgttttctctaacatcttgcaaagtttta

SEQ ID NO: 13708 - DNA, 1724 bp, Homo sapiens
ctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagt

SEQ ID NO: 13709 - DNA, 1164 bp, Homo sapiens
tctagcctattctcacagctgtcagagccatcccatcatggggggatccaagggcctgtctgggtcatcacagtgggcaagaatggcacagcttgactctccaggatagctagaaactcccacaaggctgggcaggaattccaggaggaattgcacaggaaacatcacctcactgccctggaagttgtgggtgaggggaggaagcctcagaaacaaaccaagaagccagaaggactcactgggctgggggctgtcgggagtgttcccagaaaagccgccactagctgagtggttgcctctgtagacctcaaggtctccacggctctagaaaaaggagggctggccccagcgtgacctcaggttcattttctaagcagcaggtaaggccaggggccctcttgagtttgtgatgtggtctgtccagttggtatccaatcccacagacgctcatcactgtcgtccttgtcctctccctcaccctctcaccctgcctggccccctcatcctctcctctcaccctcaccctccttttctgactctccccctgtgcctctttaaccctgccttgtctcagctctagtcagcagctccaaatctatccagggctcctagtcagcctgcccctatttcagaagaatgttctcatccctgtgtccctcctgtgaatactactgtccccttccaccctggattccccagaccttgttctatttatggtcttttccatctgtgattttcccatttttggtcactctcttcttgtctacatgtgagtggggccgtgagggccccctgccctccactcccctgacctggggccagtgccctcactttctggagctgctccctctgcaggctccagactacagctaccagattcagtgaccttttctcagtcatcctcctgactgccgaccacatcaccctgcttaaaaccctctcttccttcaacgcttctctcttggggcttttcttcttctcactttatgcacaggcttccacctctctcccactccccaaaatatcaggggtttctaaggttcctgtcccagtcttctccctcacatctgtccctcagtgactccatctgtgctcagatacctgctctgtccccagcaccccatacctggtcactggtccaggacctctggacatctctttctg

SEQ ID NO: 13710 - DNA, 2120 bp, Homo sapiens
acaaggtggcagcttttgtactgattttactctagatccagggttcatagaacttagataaaactttctcttcctccaagttcttttcttaatttaactacaggaaaacacacattctttttttactgtgttttaggtttttacatgaaatctctgtatttgctgaaatattttgatatgttgtcatgaagaattgaaattcacacataatccaaataatttcttttagcttctttctagagctgccaacagatagtaaaatggatccgtttttaatatatcatcctctccatacccacctttagacaggcaacataactggcatcaaactgagcaaaagttatgaatactgtatccttactagcccaaattttcatttttgtcactctgcagatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgttataaggaagtattaaaacactgaaacatttctccagaaccagcaagtaagggatatgtatgtatttatgctcagttttagttggcctaaagcagagttgaatgggctttctaaatagctaggcctgcaggtacctgccactactcccatcttcagaggtatataagggagaatgtgtagcagttggaggcttttgctgtttttaaaaaagccttatgaatcagcagcacatcgggaaaaatagctcacatagtacctggttttccacaagtaagccaagggcatgattttctgtgtacatttattaacagttctttggttttatgaaatactcatatgaagccagtccctggagtactgttttttaaaaggtccctttgaaccatttgtaaattatattttcattcataacctgc

SEQ ID NO: 13711 - DNA, 1104 bp, Homo sapiens
ctttctgtagtttacctgctgattttaaataaacctgattgcttactcaagcaaggttggaagtttttttaatcctttaatttaaaactttaaatacagtaaaaatccatgacttcttatatttcccctcatttgcgtatttcacttaggatgctcttccctttaattaaactaaaattctgttcattttccacttctcaattatgcagactagctataatatttaaagttacaaattctcatattagaagaatcttggacataattcataatacgtagcttgtaatcaacagtaaactattacttccaatggatctaattacttagaatttataatactaatattggatgcactcttttttatcttagcaagggaaactaactgtgtatgatagacatttttttgtaaataacatttcgcttttccaaagcatgagttgagctgttattttttgtcctgtagctggctgtgggcgctagccccctgactgttgttttaaatgtcccctcattgtgcttctgctcctttactagtgggcctttggagtgacgctgtgggaactcatgactctgggccagactccctacgtggacattgaccccttcgagatggccgcatacctgaaagatggttaccgaatagcccagccaatcaactgtcctgatgaattgtgagtttttttgagcttgaaggcatgagttttattccatttactatattggaataaaggaaaaagagcaggtttccatattcacacagagccttcccttttgagaataatgactctttggatttaaattagactcttataaaaaaccacaaagtcagggagattcgttcactctttcatgcatttgatattagaacgtcttgcattttattttatagtgcataatctaagcactataaattagtctgagaggacgtactaagaaaattgaatgctacgtcagttattctatataaagtgagtatctgacttttatagttataaagtagttataaaggacatagtagttataaaaaacctctctcgttgtcattttgccttgccagttagtatcagctaatacagggaagatgatctggactagtaagccaaa

SEQ ID NO: 13712 - DNA, 1167 bp, Homo sapiens
tagtttgtcctaggccgtacagctagtaatcgatgatactggcagttctgacttcacggtttatgctcttcatctcttttctatattgacctatacccactgcattataaactcatatagatcaattctgtaataacgttgagccaaagaagctcttccagcactctgaccagatgatagcctaatgaatctttattatagtctctttgagttgcaaagtatcttcgcagagttgctggagaaacagggctaactgcagcatcacaagaagaagtatcaggttggtgcagtaattgcagtttttgtcattaaaagcaatagcattaaaagcaatgacaaaaactgcaatttgcaattacttttgcaccaatctaatagataacctaaaatgatggacatcttcagggaaggcatgctgggggggcatttcattaggcaaacatgtatcttgagatctatggttgtgctgagcagaatggtttgcatattataagtgctctccaaatgtttattgcaggacatttctatcttaatttttgctatgactttctacagatgtttggttacaatagcagatagtagtatattgtattattagccatagaaaggctacataaagacttacagtcctcattgcctggatgttatatatttacatttttcagatttgtgtatgggctcttgaaattgataaacattcatatataaatgttatagattacatagcagccgtgtgtgtgtgtgtgtgtgtgtgtgtgtgtgtgtgtgtgtgtgtgttttgtttcagagacagggtctcactatgttgcccaggctggcgtcaaactcctggactaaagtgatctgcctaacagccttccaaatagctgcagctacaggcttcacaccgcactcagctttattatgtatttttttaaatcaccagtttttgaaaatacagaattattatgtgggaagtggtcagttaaaagattttgcatattaaggaaagttggagacttgattgggcactgctgatcctgtagctaagagaggcattgaaagacctatcctgctatctggtttcacccttcatgctgaatttctatgtttcacgtctccactgctgcaaaattataagaactaaggcagtgagaccgaaatgtacccacgagacaaggtttctcc

SEQ ID NO: 13713 - DNA, 1216 bp, Homo sapiens
ggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccacggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctttctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcagcaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttc

SEQ ID NO: 13714 - DNA, 1209 bp, Homo sapiens
tcaggccatggtaatgaatggggggtgggggggtggcattcctgtcctctcagcccagcacatctgggacgtaaatcaagcatattggaaggtaagctggtgctcacagccctcaggggagcctttgagtaaatccctgccttggttggttggtgtagtaaatggtagatccctctgggcttgtaggaatttatgccccacggactgcattttacattttaattagccctctagcttgtctaatatccaagctttttcaggcttagtctactgtctacacgggagctttgtccttggggtccaggctgattggtggggaaggcttggtagtggtggctccagcccagccctgagcatctgctgccctgaagaatctttggcctcctgtgggctctgtgaagttgtgtgctgcccaggctccagtgggcttcttgttcacaggggcagccatctccccggattgggcaatgccaagaaagctccattatggtcccacaggacatggtggcagcaactgtttgcaaaatagcagcctccctcaacagcagtttgtgcccaaaaacagactgctgaatgggaccagagcctgtaagatgtgtccaattttgtctccttgtggtctgagctggtggctgacagtggtccagggattgctggctcaagagaagagagcctatgatgaaacagctcagaggaagccctggagattcccagagggaaagggaaggggactgctggttgtttctctgtgtctgtaaggagagggagtttagccttttagttcctgcattctgctgaccaaagggtaggattatttatataggatctagatgatttccacaccctggtgactcagctggaggtggatcctgaggttaacataatcacgatgatgatgatcataataataatgttaataattggtactcagtgaatggtagttatgtgcaggcacagcactagatgagctccttccacatccatgatctttcagtcttcgtattaccctgcaaagtaaatagtattttgcgagtgaggaaactgaagctcagaaagttgtctgtgatcacagagctgtaactggcagaggtggggtctgcctgccctggcaacctctccagcttcatatctttcagtgtttctcttgctgtttaaacttctgtagccacactggcatcttggctttctcagcaatgggccaggcacctt

SEQ ID NO: 13715 - DNA, 1995 bp, Homo sapiens
ccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaac

SEQ ID NO: 13716 - DNA, 2166 bp, Homo sapiens
tttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaggcttgtggtagtcatcctattgtttctaccaggtatggctttaaagagatgattttctgtcctgtggctcttgagagagtttgcaatttctgataatctgttaaatggcagcaagttaaccttattagtgagttggtggttttgttgttttggcttttta

SEQ ID NO: 13717 - DNA, 1155 bp, Homo sapiens
gggttttactatgttggccaggctggtcccaaattctgatttcaggtgatccgcctgcctcaccctcccaaagtgctgagatttataggcatgagccaccgtgcccggccgtatgtcttaatacttataacttaggtgtttgtattttttttttgaaaagactggcataacactgcccttcatgactttataaaataaacaaaataaataaaaatattcctaagccttcatatttttgtactgaagaattagtcttttgcagttatattttgcatttatttttgtatagcagctatcatttccacaatcatttcttcctcttcatttccctctttatttgggggattcatttcactcactgttatgtgaaattaggaagggaggataacatttttagtttgctagagagtttctctgaaagtagaagtataaaccacttctaatcagccatatagcaggtggtaaggaaagtagtgaaacagaaatgcattatacttattaatttgttcgctaaaataatataacattttctagggattcaactaatgaaactactgcccattccgatgctggcagcgagcttgaagaaacagaggtcaaaggaaaaagaaaaaggggtcgtcctggccggcctccagtatgtattatgcttgtcttctttgttcctttaatagtgaccgtgttaatgagtttatatgagttgttaattctagtgctagtatggttaatacttaaaaaaaattcagtgacacaatagagattggaaactttttttcacataaattgtcttggcagtgatcagaaaaaggagatgattgtagtatgattttgttgccctccttctctttgtaaataaatggtagtccatgtgaaggcatagagaaggtcactaacagtgaatgaggtttagttagttaagacttgctgcttttcagatgcaactctgatttcttatgagctcccaagtactgttttggagtttggggccagtctcagagtatattctcattgataacctgattgggaagtttagaagagctctagataatcctactttgagagatagcttaatgtattgtacgagcatcagtcataatttaagcatgcataaaccctatagaagatactgttatctgcttgtcaaggggttaaggg

SEQ ID NO: 13718 - DNA, 1218 bp, Homo sapiens
ttttacaaatctgtaatgacacatccatcacacatgtttcactgccctaaaaatcttctgtgatctgcctgttcatcccttccacccactaaatccttggtaaccaccgattcttttactggctccatagttttgccttttccaaaatgtcatatggttggaatcatgcagtatgtatccttttcagattggcttctttacttaataatatttaaggttctttcatgccttttcaaggctctcaagctaattttaatgccaaataatatttcactgtgaggatgtgcgtagtttatttattcatttacttagtgagaacatcttagttgcttccaagttttggcagttatgaataaaactgctataaacatctgtggacattggttttcagctcatttgggtaaatgccaagtagtgtgatcactggtagtggtgtggattgattgtagtttatgaattttgtcatcctcattttattttaaaataatttcttttttttaattgacaggattgcctttgaggttattttaaaagttttgagttgtacagcacttgattattttgctgcattgtgaaaggacctctccagcaatgattacttcagaattaccagtgttacagtaagtattgtaattttcttttttttatattttttaaggaaaattttggacaacttatttctttatcaaaatgctctcttcgatgatacatttcaaatatgttctttgatattgggacaatatctttgcagtgtaagtagtagtagggtgtgtaattaccgtatccattcatggcttttgctattgaactgtcaacatgttttctgatattcaacaaaaaagatgttaatgtcctatatcaggagtcagcaaactgtggcccatgggccaaatatggcatgttgtctctttttgcaaaataaaattttggatgagagccatactcattcctttacatgctgtttatgactactttgtattacaagttgtgacagtgatagtattgcgtggaaagcctaaaatatttagtctggccatttacaaaaaatagtttggtgtcacctatcttataccatactctttctctaccccttctctaccccccctccctgctcacttccagctcttttattatgattctttctttttccttagattgagattgttgaggtgttccggctaccagaagaaatgtaagggatacaccagttgacatttt

SEQ ID NO: 13719 - DNA, 1156 bp, Homo sapiens
atcagtgtcaaatatagtgttcacttttaaatggaagcatattgtgtgcattttaggtcacattgatacgaacactgcaaagtctcagtgctatgtgaacagaatccaaaaataactgggaaatgtagttaatgactgggaaattcactaaaatctaaaagttgtaaactttttttttcttcaactcagttaatgttattgaaagttgaatttatggactgagttggaacatatcctttttttccccatagcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtca

SEQ ID NO: 13720 - DNA, 1198 bp, Homo sapiens
acccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtata

SEQ ID NO: 13721 - DNA, 1386 bp, Homo sapiens
ctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgtatctgtcttagttccttttactccagtattcctgaagttttgctgagaacattgtgagttgttggtgttttgcccagaacatccacgtcttacagagcatgaccttggtgctaaccagatctgaagtaaggaggagcccactggtggccgtggggtgtctccttcctgcatggagctggaggatgaaggcaggctagcacagcatttagaggcactacctcttgatactgggcagatctggattttagccctactaccgacctttgtatgcctttgggcaaatgacctgccttagtcttgagctgccttgcctgtgaatgggacactaatgtgcacttcaaagtagctggaggactaaagctaatgtaggagtgtggtgaggagcccagaaacagtgctctttgtccaggacacctattggattatctgcctgacattccttttcatagaaactgccctcttccc

SEQ ID NO: 13722 - DNA, 1233 bp, Homo sapiens
attccctctgcccctgtgtattgtagccattcccatagtataccaagttttggtgaaataataacttgattcttagttttcttctaatatagtattgaaactgtttttcagattcttagtctttctcacatattttaaatgtgatttattaatacttggtttgtaaataaaaacaatgaatcttttatgtgtggctttaaaatatgtattgtgaattactttgtaaaactggtaggcaaactacatttctttatgaggttttgagttgtattttttaaaaaaatataattgtatgtttgtcttctgtacatgagatttattgttttatctgggttttttgatctttaatggtattttcctccctagtttcatctgcttgataaaagccaagcatccaacatccaagttagtttttgttgaatatactttgtattctttctatattcttttattattgttagttactgaaaatgacacctttaaaaaatgtgtttaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggtaggattatatttttttaagaaatattttgtaataaatttctcatttttacccgaatacaactgcatttttagaagtgtctgtcgcttgcctagcaaacactattagaaagaacaattttatatttcagatagaaatgtatttaggattatatataatagtctaaagtgatattctgtacacgtatctgttttgatacagtggaatggtgatttagaatgggattggcaaactggactgtttaattggtttttacagttttaaagggatgttaaaaagagaaaaaaacctcaaagatttgtaaagggatgtttaaaagaagaagaagtaaaaagaatatgcaacagagaccactgtgttgtatgttgtttgccaaacctggtcctttacagagaaagtttgccagttgctggtctagatagtgttccttattggaaatatttttttctcatgtgacttttctcccccatcggtagaaatgaaagcctaatcaaaatggtctctttgtttcca

SEQ ID NO: 13723 - DNA, 1149 bp, Homo sapiens
acttcatctcaaaaaaaaaaaaaaattccaaggaaaattttttttttctagaaataggaaggattttactttgcattccttattctgccatatcaccctcagatatattcagctttttattgagagatttctgatgttggataaagtaattgtctttatttttctttctgcaggttcttggtgagattcaggaaattgtgaaaacagggctttgggtaggcgattgcttcatttacacaagttctgtgaacagattaaattattatgttggaggagaaatagtcaccattgcccacttggacaggtacctgagtatcattttgcatttgtcctaaattttaaagtgtgtttagaaaaatctgttgctggcttgtagcaatgataggctgatttttcagtgttatagttttagtaggttgcctattgttaaccagaattgtgtcaatcaaatgggaaggttttgagcaagagggagattggcggggtgtgtgtttgtgtaattgcagatttgaatttctaacttggtttctgtttcttttataggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcaggtaagaggttttgtttttttctttttgttttttaaaacttgcaatttgaaagcaaattattatggagttgaaaaactttatttcttaattgccaactgatttcctgtggcaatagaatttctcctgtgagtttaaggcacttattacagcacatgatacacccttcttacactcttccttctcctttctcagtgccccctttaaatgttggaggtgattttcagtcttccttttctgtgcacttattttccagtctcctgatattttcatttctacactgcatttttagctttatcccatctgctttttaaaaaaaaatgattaaaatacatataaaatgtaccatgacatgactttttcttatgtaatgttttttaagcaaagttacatatgtgcaa

SEQ ID NO: 13724 - DNA, 1131 bp, Homo sapiens
aacctggagtgagatatttttattcatttgaatgatcagctttaaaatgaagatagtctttgtaataatatagtgccttcctgtggtataaatgtcatgagcaaagttctaggcatcttggtgctcaacaaatactggttgaataattggaatcctcctcctttgcatttccagccattctcaccttcctgcctccagttgcctttatttatgagaagaccattccaataacatttcagcagtaatgccatattcataatttccttttcaatttgttggctagaattttttttgtaactttgtattcaaagaaatgtataacttttaaaagatgttaaattgtaataatgaactaaataacatttgttattagaattcttttaccataacatgaattattgttccttaacttctacatgtctttggtcctctgtacttccctccctggcttctgtgatttctaggtttgtggtggtgtgtggtgatggggagtatatcatctacacagcaatggcattgagaaacaagagctttggatctgctcaggagtttgcatgggcccacgattcttcagagtaagttttgattgtatgatagccagcatgccctgattgcagatgtgttgtgtgctgcttgaagactctcaaggcttgatgtgggctgtgattctccgtgttaaaaaacagttctcaccagagctgtccattggaagatgagagtcagaggcgagtgtatagcatgagccgtcttagtgctttctttgttctgcgttaggctggctcactcaagctgatacaataattccatttaactggggacccagcacccatttctttgatggagcccatggcaggacctggtgctttatgggcttaaggcacagtagaccctcatgtctgccttggcaggccttggcatgccctccctgtgatgtagtgtcctgaggtgctactgcccctttatgagctacttgggagtgatgttgtggtttgatcattttgatgagaaatttattaaatcttttttaaaacttattttctgtgatagtacccactgcccattcttaacaaatttctgtctgaattcagaatgttcataaaatgttctcattaaaagcaggaaagatcattt

SEQ ID NO: 13725 - DNA, 1188 bp, Homo sapiens
ggcagcaaaaagaacacttcatatgcttaaaacccattctttttgaattagattttgattttaaatatttaagtctggtgtttgtgagaacacttttctctttgctcagtcttttcgatctggttgggtagggaaggtgttcctcatgctctctgggtggctgccttattcatagttgagagagctgttaggtaaaatctttatatgtgttggggtttttttggtagggggggtagcaggtaaaggtggcccatggctagggcagcaaagatgaataatttgaggaagcatttggttggtggactcatttgcagagaaacagtggtgacaacaaatcagagctgtttccctcaactctggctataagaggtcattctctgcatgtcagctacaaagatcaggcacttgaatgaatccgctgggttggcaggcattggtcatcttcgcaacaccctcttcctcaccatggatgagaacaagacgggagtggttatatcccagtaacagaagctttgggaggtatccaggtgagcagggtaatgtggcttgccctcccccagatattctgatcccaagaaaaaggtgtcattaatcagtctggcattttccaccctccatatgctggcatccaggaaccaaaacccctgaaggcctagacaccctatgacctctaactgagatgttggcagccaggcagatgcaggctcatgtccaggaggaactgctgactggtttggccacagcccagttcattgcttgtcttgccaagtggacaaccagattctgccttcctgagcttgaaaataggctacaactctcaggtgattcagatgacatggaggagaagttggaggagaagattgaaatgcttaaatcccagtgcagaatgagttgcttcagtggagtaaagcaaccggctagttggtagcctgccttaaaaaatactaaacatatatcatcatacatttgatcaaatgctgtaagcacagccaaggcccaaattcatctagataccaaaaatgtgatttcagtgaaatctcttttcattgccgctttcttttgttgttgtttgttttttgagccagagtcttgctgctctgtcacccaggctggagtgcagtggcacaatctcagctcactgcaacctccacctcccgggttcaagcgagtttcctgcctcagactccc

SEQ ID NO: 13726 - DNA, 3556 bp, Homo sapiens
aaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctttttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcacgtattaggcagaaacagtgttcataacatttttctgggttttaaatatgttgtttcggatatccttaatataaatgttttaggtattctgtgtaccctgtcgtacccccaacattatagaatattgcagcgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaatcgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaccaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgccttttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaatatggctttttctgtaatatatcaacattttattgagaacataatcacacttttttggattatcctatgtgtggaacaaaaatccattgccattt

SEQ ID NO: 13727 - DNA, 1165 bp, Homo sapiens
ttttctacaagcctgccggcaccatttaggattttgaaaaataatctagaaatgctataccctttatcaaaattattttttactttgcaagagcttaacagttttggttttttcttagcaattctataaaattaacatctataaaatgcatcccggaccagatacatactgtattgaaagctttcttcaggaagagaatatgagagtgttctttccagcttattttcttccttagcaaaaggattgtttgattctcagaagcagaaggacacattcattgtggagcagctctgcttaagtgtatgaaatgccttctgtctggttgcagaatttggagtttactaaacagtgtttagtgattgggctcatcttgcatcaccagttgatgacatttttctttgttccctcctacccagttgaaccaagactctgaggctgatatgcaatgtcacttacaacattaatcagatactgcatttaaggtgagctgtcccttgcctcctccttccccagtgctcgtgtgctgcatgcagtgcgtatcttgcttctgcgagcctaagatggcaggcaggattagccgtgcttgtgctgtgtgtgcatgctgtgtctagaattcattacacgttgcctagtatttcagatgtgagtatgtaaatgctctgtatgccatatcatctggtagcgaagacttgtttttgcctcattacagccttagatatttcaacatcacctttcatttccaattcatttgcttctggatgtttgtttttcatcacattcaaaatatgattttacctttttttttttaacaaaaccaaaaccccccacaaaccctaaaaacaaaaacaacaacaacaaaactctgctaccagatggtgtctctcctttcttcgtgcatttgctgtcttttaaataatgtatgttgtattgttaattaatgtgaatatcaaattaaacacttgaaacttacatgtttattatgcaggtaggaggcaaggtggattctatttttaactcttatgcactccatcatgtgcaagcaacttgggttctcaaatttgtattttcaatgctggtatcagtggtttgattttcagcaaatgtgacagtggcctttgcagtggtcagctccgagctttgaactctcagaggaggaaggggaaaa

SEQ ID NO: 13728 - DNA, 1178 bp, Homo sapiens
gaatcaacatttcattggttcagaagacaatgaccaaaaggataacatacaaaccggtgtggaaaatgttgtcctttgagtggcaagaattagaaaaatcttcaaaaatatagttggtggtttttttagttatgatttaagtttagtttcattttgtccatgtgacagtcatgaaggagtgaaattaaaaaaaaaaaaaactcatttgtgaaaattccagaaaaaggatcctaatatctactttgggttttagcattaactttatgcaaagtgcacaaaaacaaaatagctgactcctccaatatcccaagtttcttgtgaaagttaataaaattcttagctgtggtatttctaccagtgaaaaaaggagtttaattttagcctagtttaaaactttctaataattgctaataagaactggctgctgaactgtctttagtcactggagaaaataagggtcagatatcctgaagatggcatcttcgtaaatatgttacgtggtaataagctgtgtgacggtctttattcccatctggcttctgcactattaaaatttgtttaaattaatggatacacatgaaatacttaaacaatataactgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccagg

SEQ ID NO: 13729 - DNA, 1195 bp, Homo sapiens
ctttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaacca

SEQ ID NO: 13730 - DNA, 1321 bp, Homo sapiens
gagaaaaacctgatgtttgcataatattttttttcccctcgagatggagtcttgctctgttgcccaggctggagtgcagtggcatgatctcagccactgcaacctctgcctcccgggttcaagcgattcttctgcctcagcctcccaagtagttgggattacagacatgtgccaccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcacc

SEQ ID NO: 13731 - DNA, 1253 bp, Homo sapiens
agatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagt

SEQ ID NO: 13732 - DNA, 1288 bp, Homo sapiens
ttcttcatgagagtaatttccagtgaagtactcttgggtatttgagtactcataaattctgatccttgtggttgcactcagctgtcttgatcaactctagccattcagtggctgttggtatgagataaaatgtgctgctttctgtgctttctcttttactaggcctgtaaacagtgtctgtgtgccatctggtgggtgtattgactgttgtgatggtgctaacagtggtgattgaaaatgggctaaacagtgaaaaaatataacacttaagaacaagaaacagaagaaataagggtcactcagactcttttaaaatgagaatagaaataagttcagtgtactagagtccacttgcatttcgttatttccttaatttgaacaaagagtcttaccagaccataagaatcatctgaggcacttaaaaatacaaattctccacctaatttttgaatctttaggtgtccagtggagctcaggagtgtgtgttttgaataagagacacctctcttccctttgtagtgaatcttgtgatcactcatatttgggaagaactgccgggaaggattgggaggatcaagttgtttgaggacatacagtaaacttcctcaattattaatcagaagatacatttcaaaactaggaaattttagttgagcaggtggaagaaaaatgagaaattgaacaattaaaaagtttccttgactgaatatgctaacagaaaaaagatttcaaaaggacatattttaactaaagataaagaagccaatgaaaaaccagcagtatcaaacctacagatgagacaaatgtttttgggtgaacacttaaaaaattattgaaggagaagggccctgcaagtgaccttagtgatttctaagatcttttaggtttgatgaactaaatgaaaccaattataatattccagataccagagcttgaattgaggagtttgcttaagcaatgaggagatactgtttaaatcttgcaatgtggtaagatggagaagaaaaaatgtttttctcctttcaaatttaagaatttagggcattcatggttctagatacaagaaaaggagggagctagctaatcgtttttagaaagtgtcccctaagtgaaaatgttcaacaaagccaagagaacaggtttgatcttctagggaaagtatgtaggaaagactgacatataagatttattcatttagaaatatgaccatagagctataaatacacttaatattatggtcatttcaaggatcctttggaaagattctggttaggtgatccatttgggt

SEQ ID NO: 13733 - DNA, 1107 bp, Homo sapiens
gagttaaactccatttcaaaaaaacaaaaacaaaaacaaaaacaaaaaaacaaaagaagaactactctgtagtgagagctagaatcctcatgttgtttatttaaaatttttggccaagtacagtggctcatgcctgtaatcccagcactttgggaggctgaggccagaggatcacttgaagccaggagttcagttacagcttgggcagcaaagtgagaccttgtctctacaaaaaaattttttttaaattagccaggtgtggtggtatgcccctgtagtcccagctactcaggaaaccgaagcaggagaatcgcttgaacacaggagtttgagggtgctatgagctatgattgtgccactgcactccagcctgggcaacagggcaaggccctgtcttaataaaataaaataaaattcttaatatgtttatatatttgaaaaactatttgtgtagagacacatgtctgtaaatacacatagatatattaactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcacgcctgtaatcccagcactttgggaggccaaggcgggtggatcacctgaggtcaggagttcaagaccagcctgatcaatatggtgaaaccccatctctacta

SEQ ID NO: 13734 - DNA, 1139 bp, Homo sapiens
agttgagagccactgatacaggctgttagaagaaaatcgaagactcagtgaatatagtgtcatactccttttctttctgcctcattttaccttaggaaatggttgttagcaaaaaaattagttaatcgtatcttgaaataaatagggtatctattttgctgattaataaagaaaaaataaatctcagctgggcacagtggctcacacctgtaatcctagcactttgggaggccaaggcaggcggatcacttcagctcaggagtttgagaccagcctgggcaacctggcgaatccctatctctacaaaaaatacacaaattagctgggtgtggtgacacacacatatagtcccagctaattagggggctgaggtgggaagatcacttgagctccaggaggtggaggctgcagtgagccaagttggtgtcactgtactctagcctgggtggcaaagtgagaccctgtctcaatcaatcaatcaatcaatcaatcaatatctcatgctgtaattgtcttctgatgttttcatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccag

SEQ ID NO: 13735 - DNA, 1150 bp, Homo sapiens
tagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgt

SEQ ID NO: 13736 - DNA, 1175 bp, Homo sapiens
cttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgta

SEQ ID NO: 13737 - DNA, 1246 bp, Homo sapiens
ctgagagtatactgccttatttccttatgctttctttgtctacctccgttataaagtcatagaaatgtgttattggactatttctctttgatattagtggtgcagtgattcttggattttaggatatttttattttaaactatcttggatgttacattacttaatagaatcagttcttcaggacatgaaagtaaattgtcaatttgaggctaaaaatagagaactactagatgccttttagatgaactgaaatgaagtctgaatagaaaaacaatttagctgtgtgtcttgtagagtgaaaaaacaagaaaaaataatttaaaatgaatgttgagagtaaggatgactttgctgcataactaagtcagtaaaatgtataaatgatgagtagtagtgaaatcagaattcttatagttgaaaatcaaaatatagcaagtatattgtgacatatcaaaggtacaaaaatttagtttgctttgcttagaaattttaaactaacatgaggaaatattataaatacattaacaaaaaactatattgatattagttcttatatttctattatactatttcatattttcacagcatttgatgaccaatgaagactcaccaattatagaatattacccacctgattttaaaactgacctaaatgggaaacaacaggaatgggaagctgtggtgttaatcccttttattgatgaggtcagtgcatgaaataatcattacatacacatacattcttaatcagagactatttcacataggttaatgagcaatgggttttaatcaccatttatgttttgttaatgagatttagctaccctcttcattatgtgcataaaaacttccaggtatgccaattataataaggctgaagtggctttactattattagacaaagtagtcctcagaacaaggagtaatattaccggagataaagagatattttatacagataaaagagtcagttcagttcaagaagacataaaaatcctaaatatgttgtatctaataacagaacctaaaatacatgaagcaaaaattaccagaattatagctagaaatttcaacacttttctctgaagaattaataacacaagaggacaaaaattcagtaaggatggccgggcgcggtggctcacgcctgtaatcccagcactttgggaggctgaggcgggcagatcacaaggtcaggagatcgagaccatcctggctaacacagtgaaaccccgtctctactaaa

SEQ ID NO: 13738 - DNA, 1205 bp, Homo sapiens
cattatcaaaaacagtgttatggtggccaacatttattaaaacactaacactgttgtaagtgctttacatgtacaggtttccagttctttatctgaaacctttgtggcaagctacacttagaaatttaggatttttaagattttagtgcatatttaatatttgatatttccactgagggtaacctgttggagtatcccataatcaaacacataactgtttcttcagtgagagtttaatttacagagctctttggattttctaatatttgataatagattataggcctctactctctcctttaatcattaaacaatcctatgatgtaggtactattattaatgaggtaaatgacagaggttaaaatgggatgattaggaaatacttagaaaaccacagactgctgaacctttgtaatcaaaatattgtaaaagtgaaatttttgttatagtggaatttaaggtaaaaacaaattaaaatgcactatttattttttcaggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtaaacttcagttttatatgactatgattttaaaatttagttgttaaaaacttcaaattaagataaaaagtgtatttcacaaaatctacgtgaatcttatttgtgaagaaaaataattggaaatacagaagagtaaaactaaactcatttgtactgatggcaaaaaaattcagtgattaaaaaaagttctgattcatgattcacattcaccgtaacgttttgatttttcaaatgctcctgttgttttagtatgactataatctttattttttcacaatttgatttttcttttcttttctttttttttttttttggaaacagggtctcattctgttgcccgggttgggtggaatacagtggtgcgatctcagctcactgcaacctctgcctcttaggctcaagcaatttgctcacctcagcctcctgagtagctgggactacaggtgcatgtcaccatgcccagctaattttttaaattttttgtagatacggggtttc

SEQ ID NO: 13739 - DNA, 1172 bp, Homo sapiens
atacatttgaatttagttttatccatcattctccagtttaattaggaatttgggattcactgcaaatccctaaatatttattttaaaagtttaatgtaattaattttatttatttatttatttatttatttattattttaagggacggggtcttgctatgtcacctgagctggagtgcagtggctattcacaggcataatcatagctcactgcaaccttgaactcctgagttcaagtgatccacctgcctcagtctcctgagtagctggagtacaggtgcacgctaccatgcctggctaaagcaccaaatgtataaaccagcataaattggtgtttacattcagtttgaaaagatataaatgtaattatttacttagcaaggatatattaaagttctaccaaagacaactgtgtattttaaattctttatttctgatttaaagtacttgctttatatatgagattaataaggctgaatatgataacattttaacataggctctatctatcttcagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaaggtttctcacactactttttttaaaaatgtcacttatcttgaatttggtatttggatattatttgggggtgtttgtatttcttaattttctgtctgaatctacatttttctatttttaatgatcagggctacactatctggttgaaaggaacctagaacttaagaatcacttttagacaccatttctttctcttttttaagatgttaaaaacatatctgggggatatgttttttactgataaaaatcaagaataaggttcataataggtaaaacagaacactgtaagaaaagttaagtcaaggctttttaaacaaattaataattaattcctttgaaatagtatatgaagaaggttctgtattgggaacagaggctttcaaaacattggaactacttgcaaagtttatgacctagatttaaattgttttaagttaagttgttgtgtacacttaccaatggtctctctcaccaatgtgt

SEQ ID NO: 13740 - DNA, 1142 bp, Homo sapiens
tgcctgagctcaggtgttcgagaccagtctgggcaacatggtgaagccccatctctacaaaaaatacaaaaattagccaggcatggtggtgcatgcctgtggtcccagctacttgggaggctgaggtgggaggatcacttgaacctgggaggtcagggctgcatgctgcagtgagccgtgatcatgccactgcactccagcctgggtgacagagcaagaccctatatcaaaaaaaaaaagtgacatttattaaatataaagtaattttaatttataagtatccattttaatttcctaaaattctgtgtgctatacatacttaaatatgaaacattgacattataagagaacttaggattcttcatggcatattatttgttgacaatatttttacagtacaaccttgacatttaatatgttaaattaggtattgtatactcttgtccttcagctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggaggttgataatttttgtttttaacatttgagtttacgtcaacctagctctaaaaatttctttaaccagttaattttattgttctagctttttgtcttaagaatgaaggaagcatatacacatgcccaaatatcaagaaataatgagctgaaggataccttgattcttacaacaggggatattggaaggtatacttggcagcatttgtgttcttccttatttattttggccattctccatttttatttgcttgctgttaaaaatggtgatatgatatttgtgatattatagacaaaatgtgagtcaacatgaatttatttgtagatttccgtttgtttctgggatattggagatacatatgtgtgtgtatgtgtgtgtgtgtgtgtgtgtgtgtttgtgtattcatatgtatgttgtttttaattttagggccgcaaaaggagatttggtaccatttgcactcttacacttattgcattgtttgttatccaagtcagcatctg

SEQ ID NO: 13741 - DNA, 1155 bp, Homo sapiens
accaactattttttataaagtggctaagttgccatatttcagttacttctgaacattgttttaattgttttaaatcttagtataaatttcaggctgggcgcggtggctcacgcctgtaatcccagcactttgggaggccgaggcgggcagatcacgaggtcagaagatcgagatcatcctggctaacacggtgaaaccctgtctctactaaaaatacaaaaaattagccaagcgtggtggttggcgcctgtagtcccagctactcgggaggctgaggcaggagaatggcgtgaacccgggaggcggagcttgcagtgagccgagatggcgccactgcactccagcctgggagacagagtgagactctgtctcacaaaaaaaaaaaatttttttgaatagttgatattacatagtatgttttattctaaatatgtttcatgttttaaccaaatttatattgcatatgaatatctctctactatattcataattatagaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactggtaaaacaaacttcttgtttcttggggttgggtttcctgtaatgaacttggatttactgtttactcattattcacttgactcatgtaaccttagaacacaaacttttcactgaagtagttaataaatttattttctattgagtcaaatgctaggtacggtgctaagcactgtatatatcttagttaatatttacaatagtcctgtaaggtaaaggctattatgcctattttaaaaattagaaactgacactcagagaaactgaggctcttttttgtctgaagccaaaactgactttcctggggacacatgattagaaagtaccagaacacatttgtgtacaactcaaaacccagtgtttggctgttgaagacagggtctcgctttgtctcccaggctggtgcacagtggcatgatcatggctcactacagccttgatctctatccggggctcaagtgagcctcccat

SEQ ID NO: 13742 - DNA, 1209 bp, Homo sapiens
accttactagttgaatttggctttttgccgatgagagtcttaaaacagattttatcatccaggcacaatggcgtgtgcctgtagtcccagctactttggagtctgaggcaggagaatcgcttaagttcagtagtttaagaccagcctggggaacatggcaagacccccatctctaaaaagcaaaaacaagaaacccagattttatcgtggatggaatacatgtataatcttaccatttgcagaagagaacatttatctagaggtaacttacagtctaagttgtttcacacatgatacatagagaaaaagattaatttctgtattctctttctttaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacagaacaaccactaaacttctttttatagatagtgggacattgtagaaggaatattcccttttagcaataagaatagtgtgatttatgcataagattgcctttgtatcaatttacactttgctaaaagagcattccaagaatttcagggactaaatggatccagtaatgtcaatagactataattcttctctctgcagaaacagagaatgttagtgctagaataacatctctcagggatctagtccacactgtttcattttgtaattgaaacggaagc

SEQ ID NO: 13743 - DNA, 1180 bp, Homo sapiens
atttgttaccacagttcttttcctttatcttcttctttactttttttaatcttctctgcaaaagtttttgtgactaatttcttttttttttttttttgagacggagtcttgctctgtcacctaggctggagtgcagtggtgcgatttcggctcactgcaacttccacctcccgggttcggtccattctcctgcctcagcctcctgagtagttgggactacaggaacccgccaccatgcctggctaattttttgtatttttagtggagatggggtttcaccgtgttggccagaatggtctcgatctcctgacctcatgatctgcctgcctcggcctcccaaagtgctgggattacaggcgtgagccaccacgcccagcctttgtgactaatttctaagtagaaaaagttcgccaatttttttaataacctggaaagcattttattagtaagtggtaagaagtcactggacccaaagaggaaatattttaatacaatttaaagccatcttaagtatgaataagcattattcacctatcactggcactgactttttaaaaggtagttcagtccaaagatgtgtggaaattatggtcaaagccaaaattacctttgtgtccatctgtgatgctgttgctattatcatcttcacctggattactgtgtttgagtcttctctagctaataggaattaatgtcctttatcttccctgaagtagcaaggagggttcttgcccacttgctgctcggcaagattgggtaccagctgtcataggtaataataaatccagtgaggtttcctttgattcacatgttggaaatgttcttttaaacatttgcttgtatggggaatgattgattgcctatttaatcaaaattttctattcacgtgaataatttaggacactattattggtactagtgcaaaaaattgagaaatactaaaaacctaacactgactttgtagatcagtgcttctgtgcaacctcttcaaaaataaccacaccctgattaggccgtgcacggtatcacacatttcaaacatacttcaagaagacactgccatcaattccacttccctgaataactggtcctgaaaatttgacttctttacatctgatagaaatgtcagtctccttccctcaaaaggggaacaactctatccactcagctcaccctccta

SEQ ID NO: 13744 - DNA, 1152 bp, Homo sapiens
atctcagctcaaacataaccttagccttctctgacctctttaagtgaaacttagtatgctaatagtatgatacgcccttttgctgtagcagttaccatagttacagataagtatatattgttgtgatgatctgatttcctggttcccccacccctgcaaaacaacagcaaaaacctttaccaggctctataacagggggaccaaacttgtttttgctcatcattgcctcacaaggtacctggcaccagtgagcacttggtaaatattagataaatgcacaactgactgcttctttagcaaactggatgatagaatatgttcttacattgtacctcagattgtgggtatccagttatgttggcttgtactggattacaaattaatcttacaagcaatgtgacttcagcaagcaaaggaaaatgttataatagtacacatttccataggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgccttgtaagttcagatttcaaactgattaaatctagctaatacatttggtgaccaaaactctaatttccatacatgctgatatggaaaaaggttatagtttctcatgaacgtatcaagttattaacttttctatttctgatttttttcaaaattcatatacccagtaatacatttatttgtatgctatgtatataaaaggccaagaagaagcatttttttctggtcacatttctttgctgggacaatcagcctcctataatattagcaagtttctctttttgtcttgtcaggaaattataggcaaaatcttgtgctcagttatgcatgatcctaggtacctggttttatcagtttttattagtttttctaacttacaacttcagttttcctagctgcctaaaatcattttgaaaataggaactgtagacagctctttggtacatttgaattatatgtttaaatattgaataatgtatgcagttttatatttcagagattaggtaaagatattaaagatttgttttacttctcaacttcttcacttgcttaata

SEQ ID NO: 13745 - DNA, 2233 bp, Homo sapiens
tccatcctccagagattttgattcagtagagcagtgataaggcacagaaatctgtctttataaacaagcgctctactgatgatcattgatgcagtgcatagtaagtacaaaataatctgtgtgtgtgtgtgtacaatagagtttaaattttagaagttcatagtcttattgcagtgatttttcactgtgccctgttaaagatcattttcgatcgtttaaggataaacagttttgatcacatgagtactttatcaattgggatttttttgtttgtttccttagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggctt

SEQ ID NO: 13746 - DNA, 2009 bp, Homo sapiens
aggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaacttagactgtccatgtaattttctccatattgtttttccgatgcaagcccagttaataattagttttttagcagctttctctcaagtgaaataagtgatgtgacatgtttatcagttatggctaaaatgttacactttacatgtttaaactataatcatatgttttcatgctagatggttctcttggttaggaaagttcatttccttattggtttccttttttaaaagttattttattctgtttaattgaggaaaattttaaacattctacaaaagtaaaatagtacagtgaaccttacataccataaacatgcagataacaacttacatgtatctctaaatactttgtttttaaaacatacctgcagtgtcattgtcacattaacaaatcattgggtcct

SEQ ID NO: 13747 - DNA, 1201 bp, Homo sapiens
cctcccagcctcctcctcctaagtaacgcccaccctcggttctgcccggttcctccgctcacctggagccgagggcgcgcccgggagcggccccggatcaccgcccggcggactgtccggctgtcactcgttcctcgatttcgctccctctcgcttccgctgggggtccccgcaccttcgaggggtctggggagtcggccgacttatccctgggcagtttccgggcagcgggcgccctgcggctcgggaagaaaaactttcacgcggcccagagccccgctccgcgctccgccgaacccggcgcctcccggctccagcgacgtctcctccgctttctcgggaccgcagcttcctgtctcgctcaggggaacgaagccggctgggggcgatggctgggggcggcttatatgggactcagctcccggcatagcggcgcagcccctctcgctttcggcctccgtgcggcgaattttcccacctctctggcagcggtggatggggcacagcgcgaccccgcagcggcggcggcggctgcttccatcaccgggaggatgcccgggcggacagcgcaggcaacccccgccgctccgcagcctccgactggaccaaaggaccccgaacacacagctctaggcaaggaaacccaggtgtgcagcactgcccgacccgacccaacccgcccccggtaccagcgcttctggccaacgaggtatttaagcaaagaaagaccccgccgcagccgccgccgccgcgcgaaagcggcgcccaggaggatgctgctacccgactccccttacgccgggcgcccgcaacgcgctcggaccagcctctgcgcggctcctgccagccggcgcccggttggtgcgcgccgccgtctgtcgccgcggctcctcccctccgccgcgcagccctcccccttcgccggccccgcccccgcccccaacgccgagccggctcccaccgtcgctgcgcctcgggggctggagacgcgacccgctttaccgcgacgcgcgggggctgcagtccacgggtccgaaggcttagctctgcgcgcaaagcgccgggatgcgaacgcgggatctggagctcgtcggtgccgagagctgccagagagttggattctgcgtgcagctgccggactcggccccatgtttttgctctcagaaagagttggtgatgaagtttgggcagaaatcccctg

SEQ ID NO: 13748 - DNA, 1319 bp, Homo sapiens
taattagtgaaatattctatttttggaagcaatgaaaactatttaaaaaatttttttctacttctgcttttcctcctttcacagataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaaga

SEQ ID NO: 13749 - DNA, 1165 bp, Homo sapiens
attgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaagaatcacacttttcagactatttcttaacttcagatatccacatttttcttgagtggaaagtgagtttgagtagataagttactagtttcctcttgcatgcactttaattagaattttgagggaactatctgattgggtgtgcaccaggctttaaggttatgtgtgttttctttttctgtagtagtgagtttttaaaaaacttttaccactaaaatggaattaaaagaaaaacttcattatggaaattttcaaatgtatgcaagagaataacataatgaacagtagtatatcattacactaacttcaaaagttaacaacatgtggcaaaactagtttcatctctaaactacttgcttccagcttattttgaagcaaatctgagatgtatcattacatctcagatttatattacgcattttctcctagtaaaacacaatactttttttttttttttttttgaaactgattctcgctctgtcacccaggcaggagtacagtggcacgatctcggctcagtgcaacctctgcctcccggggtcaa

SEQ ID NO: 13750 - DNA, 1115 bp, Homo sapiens
ttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaac

SEQ ID NO: 13751 - DNA, 1158 bp, Homo sapiens
gcattgaaaaatccttattaagctttagacaattacataagtttaagatgtataaggtaaagaaggtgatttttttcttgatgccctctgcaattccctgaaaaacccattttggttcagtaggaaaattgcttaaaggcccctcatcaaggagtcactgagcttcaatgttgatcataaagatttcctgccagattgaaaaaaaagtgatatgggaaatttattcatttttcttctttatggtctaaacaaataggaataaaatgatgtaatgtgagaaatactttctgggtctacttccttggattagactcacaacttttgagatggtaaaaattgagaagggcattttggggatggataacattgaagaattatgatctgatttaggcatctagatttttttttctagaatcatgattccatgaaacattagaagagtggttacggtacagtactgttcaagttgatgatgtctttaagtttttcatagtactttcataatttgagttttgctcaggaatgaaatgttgattttgtttataggtccttggtcaaggagaagaatggagaggtggtgatggaattaatagtattggagggggccagaaagtgagattaatgaaagaagtcatggaacactatgctgatcaagatgatctggttgtcatgtttactgaatggtaggagaaacaccctgtggattttaaaatctatattcaattactttttaaagagctgagatttatatttgtagatgatgtattaaaatatggttgggcacggtggctcacgcctgtaatcctagcactttgggaggcctaggcagctggatcacaaggtcaggagttcaagaccagcctggccaagatggtgaaaccctgtctctactaaaaatacaaaaaattagccgggcgtggtggcaggtgcctgtaatcacagctacttgggaggctgaggcagagaattgcttgaacccaggagcaaggttgcagtgagccgagattgcgccactctactccatcctggcaacagagcaagactccatttcaaaaaaaaattattgacaaggaattattgttttaaaaagtagatattactattctgtaggttgcccgttcgctctgatggtagtttcttttgctgtgcagaagctct

SEQ ID NO: 13752 - DNA, 1279 bp, Homo sapiens
gtcataactgtagcaacaaaagaaagtgatggattccatcgatttatgcagtcagccaaatatttcaattatactgtgaaggtatggtatatcctttaacctatgaagatcctataatgtgtgcctaaagtatgtttttcataacagcagtacaatctgtaatcctcacaaggaagatagcatttggttacataattactgttagttcatgtagtttttggctttattaatatttcctaacacaaagaaatggtggtaaatgcttgaggtgaggggatagccaaagtattctgatttgatcattacacattatatgcctgtatcaaaatatcacatgtaccccataaatatgcaactattatgcacctgtaataattaagataaaataatgctgtgccactcaaacaataatttctgaatttttgccaatgctttgtataaatatactctataaaacagcaaaaaaaagttaatatgtatttgcatatatatatataatttctttctggcaggtcatgtacaaatacaatgtaaataagatttggcagggatttttttcactgactgcataattttttctgtaatgggttttgctatcgtaggatgattctttgtttgcagggaattagaaacaaatgtgaagagggtgccttttctgtctattattgagaattgcttttgtttttgctttttttgtttgtttgtttgttttcatttagaggtatttgggaggattgttaatgtatttttaaccaaagcattttagaaaacttatctccaggtgaacatctcattgacaagtgatcagaggaaacttggggaaattgatagaactattaaactcagctatgagaggcctgccattttatttacttacttgttttttttaatagaaagaaggatctgtcagccaagtcttttctacaaataagaggagaacaaggagatacctaggtaggaacacaaaaagcaaaaaactttttttttaaaaaagaagaaagattactttttggagaaaaactgatccatttgagtatgtagtatattaaaaaggtagtttttattaaataaccactggaatactaagtatagatgtaaatatagaacagctaagtgttaatatagaacagctaataaacagctaaactttgctgaaaaagagatgtagtggtaacaactagatgtttaatataggataaatgaaaaacatgttagaaatatgttactatgatagatggaaaatgtagcagtatgcactgataggagacactgtggaaat

SEQ ID NO: 13753 - DNA, 2489 bp, Homo sapiens
agccatattctttatataagaaaaccatattgggtaaggaaagcaaagttcagttctattaaatagttattatagtttggtgcaaaagtaattgcggtttttgccattaggcaaatctttcatttagtttttttaataaagattttaaatactatgccttaaaaactacttaacttttttttttctttttaaagttcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtttattaccttcctcggtgccataattttgactttatcttcaaataaaatc

SEQ ID NO: 13754 - DNA, 1102 bp, Homo sapiens
aaccttcacctttggcagtctgaaggtctgtggtatatatggtgcccggccatgttatttatagatttagttattcctatttcatgggatttggttttatgatctggctgtccatagcttactctgtagcatgtgaatatatttatcagtagaagtaatggaacaaccactgctagatgaggggcttctagtcctagtcctcatagttactagttgaatgaccttgggttaataataccatctctgagtttcaacatcctcatttgtaaaatggggatgataatacctaccctgttgtactttatcagttgtggagattaaatgagcaagtgctaagtcttttcacaaccacagtgccttgtaaatgtgtgcatattataaataaatgaaattactatatgtctaattggtgagaggatgttgtaaaatctaattttcattcaagcaggactgttacattttatttttttaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctataggtattatagtgctttttttttttttaccagcattttatgtatatatgcctgcttaaagtacatggaagttatatttttccctttctctgtctttttaaacccacagacgttttgctcctgatatttcgtcctatgtcttgtctgatgacatcaagctacattccctccagctgctacccatttaccagaccggtaagcatgacagtgcaggagtgcgacagtgcagcaaggtgaaaatgctctgtctgggctgggagtgaagacccatgtgggtaataggtttggtggtttggttcttccactggagtctccttgtggccctttaacaaagtttttttttttgtttttttttttttttttttttgagactgagtctcgctttattgccagtctggagtgcagtggtgcgatctcggctcactgcaacttctacttcctgggttcaagtgattctcct

SEQ ID NO: 13755 - DNA, 1162 bp, Homo sapiens
acctatgtagattttataaaactgatcatgttcagaatataattttgtattgaaatttttttactcattttatcataaactttttttattaactagcctttgaaaacatagttttgatggctgtgtaatgttccattatctgagtgtgccatatgtatttactcatcctttgttgttaaacatgtagattacttctaaattttcaatattgcgaatactcttgcggtgaacatcattggacgtaaatctttaaccacaatgttgattattctcttaggatagagtcctaaagaatgcccattggttttaatttgcagtccacacaaagcaaataaaatcatgttatttaaaaatgattgctttctattaaagagatctttaaactagaggtagtttcaagattatattatacttagatttattaaataaggaccacgtgcatgtgctctaatatggcattctttctattttatttttggcaagtgaggtttagtcttaagaaattgaattctgcatgttgtgttttagtttttgaggtgcctcatttcataacatttcacttttctgttcatagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccgggtatgctttttcagattatgtttttaggcttgatcagtgataatcagatctgataacctcatttcctttcctgcaaaatggggacaatttatgctaatccaacatcataaggctgtgtgggtccattgagcatatatgtttaatatgttacgtgttttgagtactattaaatgctgttaaaatatatggagatggtatattatcatcattaaacatcttttgtttggagatgaagtagttgattacctgaagatttgggaacagtgtatgatgggaaaatattttctctgccatacggtttttagtttagaaattagaagaattttggaccttagttcttttttttcttcattccttccttcttgccacataggagatgat

SEQ ID NO: 13756 - DNA, 2314 bp, Homo sapiens
acacctttgtcatgggaaggcacagatcatagatcagatccacagtgcctttcacatgctcctttcttatctccttggccttttccattctggaccacacctatccagaaataattttcgatttcttccacatctctgtacctcttatgagtaagggtcaataatgtggtagttgaagacatgaaggtgagggttatgtaaatacttgaactgttcctccttcaagagcctaaaagaaggaattaaaatggtttcttttcattttgttataggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaag

SEQ ID NO: 13757 - DNA, 1104 bp, Homo sapiens
tatgtcacccaggctggagtgcagtggtgcgatctcagctcactgcaacctccgcctcccgggttcaagctaagtttccagccttagcccctggggaagctgggactacaggtgctggccaccatgcctggttaattttttttttttttttttttgtatttttagtagagatggggttttgccatgttggccaggctagtctcaaactcctgtggcctcaagtgatccacccaccgtggcctcccaaagtgctgggattacaggcaagatgctcaaaatcttttatcaattgttgaccctttaaaatccccacaatatatcttgacggtaaactaaaatggtatttagtttataatggaaagcattaataggatatgtagaatattagatttagaacccgggcgtatgaatcttagcataatgcttcctgggaaattctgaaattgattccatttctgccgttacaaacacacacgaagttcctagttcactgggacttcctgatttgttcttttagcttgctccttctcacctagaagctctgtttatttctgagcaaccctggggcttgtctcataggacaggatttatttatctcatcaaggctgagtgtgccttaggaagtcataaacataaaaagagaagaaaaaaaaaaacagaatatgagagttgtaagccttcctactgctgagatactaagttacaatgggttgaatttaggatatgcaatagtctggcttctaaaccctgatagtgtttatttatagcaggttagtggctgtggggtagggaggttatagaggattagcgtctcatggaaaggctcttatacttaaaagtggtaccactggctcagggcagtttcagagggtatgtgccgggaacagggatattaattgcggagctggctggcctcgtgctggaagagatggtatcaaatagagcagcttaggccctgctgctgctgattttcttttttacactgatgatatattagttactttagtattttgtgcaaagctatacaaatgtgtgtgaaatcctttgtcatcccccattctgctggaaagtgaagtaaaaagctacttgtattctagcaatcgt

SEQ ID NO: 13758 - DNA, 1764 bp, Homo sapiens
ctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaatactctaggctcctgttgtttatatacattgtttatataaactgttaaaagttgatttttgacaaagtgggaatacacagaataggccaaagtctgctgcaagcataaaacttcagcaatattaggtgatggcctacttcaagtaatattacagataaaattagtgcctgggaatttctttttaatggactctgatctgttacacatagcttttagtcatttcaggctcatcttcaggagtatgtgagaagcaactgacttatctgctagaaaataagtattttcctcttcttgctggtttctagatgtgaaatctaatagtaaagggagtaccaagaagggtttctgcactattgtggatttttctgtattgaaatgtcatatgactttagatttggaagctgtgttggcaggctgaagtcagccagctggggccctcccacataagagcagaagacattccttaggcagcatataagataattgggat

SEQ ID NO: 13759 - DNA, 1100 bp, Homo sapiens
ccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggtatggaaatctctattttaaatatttgatagaaatgcttggccaacattgtagcttaggatgcaactttgggagattgttgtcaacggaggcccttagcatttttaaatacaaaatttagtttttggtaaaattgatttagattgctgatgctgatgtcaaagggtgtaatgagcgaattggtcttgtcaccgttgtttaaaagcactaaaatgggtagggatgcaacattgtttactcaaaaaaaggtgaatttaagcttaatgcttaccatttaatggtggtagctagtgtgttatgctcccatagaattgtccttttcttacatatcaatcacacttgaacacgtaaggcagagagatttgtcagtgtgagttttgaggctgagacataataatactacaagttttcctttctggaaaaccagaaggtcctctagtgaaaaaaaaaatctatgtaaggaatcttctccagtgtatctggaaaggctgg

SEQ ID NO: 13760 - DNA, 1695 bp, Homo sapiens
tatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaat

SEQ ID NO: 13761 - DNA, 1221 bp, Homo sapiens
tgctcctaccccatgctttttccactgtgttactgtatctcaccaggaggagactacagtgagtagtattggtgtgtagttatagtgatctttgataatgtattcagagtttaacatgttccttttaggttctctcatcaatctgatttaatttactcttttttttagacacaattgcaaataaattgcatttgcaaaaaattaatgattttgtattatcacctggaccccaaccatacaaggtaattgctgtttttgtttatgtgtaatattatgtgtttaaaccttttcctagttttttgtgattgtaaaaacatgtccatctcagtttttattcttcaaaaaattaagtaatgatttatgtctatgtatcttaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaaggtatgttaagtatattttatccctccctttgtttatcagttgttaatttaggctatattcctatgtgtataacagaagaatcaatgcccatttgtgttttaaatctaattaaagtttttactgttatagctactgctgtgttggtaatagctagcacagatgttgacaagacaggagcttcctactatggagaacaaactctacactacattgcaacaaatggagaaagtgctgtagtgcaattacgtgagtattccagcagtcttcctttgattagaaacaatgatagtaaaaaatactatgccataaagatgatataatctaaattcttgatcaaaagatagaattcatatgccttaataacctttaagataaaatttttcttaattaagaaacttaaaaatcatcctccaacataccttattttggcagaatacaattagttatttgagttacgccatcgttttagaagtgaacttcctgagtaaggtaattccattgtagtagctcttttggaacttacttagctaattatgacggcaaattgcttaatactgtctttagaattgttagtaatatgcaagaggccaggcatggtggctcgtgccagtaattccaacacattttgggagtctgagatgggaggatcatttgaactcaggagttcaagaccagcctgatcaacatagtgagacccta

SEQ ID NO: 13762 - DNA, 2127 bp, Homo sapiens
gcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgatttgaaaggaactcctactttgtggaattaaatctacattagagcactttatatggtaactatactcacaaaattttgcattataaaagttattatcattactttttaatggcttcttaacccgaccagtgtttatgactcactatcagtctggcactcaagtcttaccatactcttggaccttatgctacttctcaagccttacggtctacttgtgcttcagtgctgctgaactgtcaatagctctgtgatgtattctgtgct

SEQ ID NO: 13763 - DNA, 1197 bp, Homo sapiens
gtagtctctcttttaaattttgtactaatgtcacttttagaagctttctggaaattgttactcttatgaaattttaatcagaaagctttgtacacacacaaaaaaaggtcctggataaaatatagagtagggacaattttcacttggtctgtcccttccaattttgagataaattctttggaggactgtcatgaaattatttttccttgctctgttgataagatgagtagctctcagcatctgagaatttgaaaatcatttatttaaaaaaaatggaaagcacaactagtgaaagttttatattgtgctacacctagttttgattatttttttcttaatgaaaattggcttaaaatgttcctttaaaaaaacaaaaactacatgcactatttgaaaatccatcaaggatatactttcttagggccagcaggtaacttacagactctttcttttgcttcccctttatttaggtttatctagtgatgaacacagtacgtgattattataaatatactatgttgtttctttttaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttgggtaagtgagagaatacaatacaccttacatttcattattgattttgcaagtaattgttgcctgtaccctctggatacagcccagcatggtgagtgttgagaaggtccgtggtgagactgatttgctcgggtatggatagggcagctgttcctagttcactcagtctcagaatcctgactccattagcaagggctgttgatcttactgccaaaatatatcctgaatctgaacacttttcaccaccacagctgttgaaatgctggttcaagccaccgacatctcttaactggttggagtcacagccttctagcagctttctctgctgttacttttgctccttacattgtattctctgcataactactatactaatctccaaacctaaatggtatattgtgtttctatttataaatttgcagcaattttttattacagtgggaatacagatccagattctttactgtggccagtgaagtcatcgctgatctgcccccacccccggctc

SEQ ID NO: 13764 - DNA, 1169 bp, Homo sapiens
tatgcattcttctactttatttcaatataattataatgtgttctttctcatgaatcacaatatataactttaaaaaaaaattgtttggagtacagaccaaaacctttatgtctattattcattagtcttactagtttattattatgtatatgtttctgtacgaaatgtagccctacgaggaaaacacttacccataattctgcttttatctttagctttccaggtagtgtagacacatttcttatgtgtgtggttgtcattttctcatctacaaaatggagggtgatgctcacagattcgtactgatctgaatatgaattttgtggaaattaacacaatttcttcatatttttttgctaagtggttaagtaggaaaaggtgtataagtgtcttatgtgtgtgttttggtatgtagcactgtggtttggttttgctggctttcatttacaatctccaacatttgttttacatgacttagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaactgtattcttgactaataatgatagcaggtgagttttttgcatttgctcctgcttctgttctaattctgatcttaagcttatgtactgaggttgtccgaatttgtagtgatattagtggctaattagatttagaaaatgaaattttctatgttagtatccttttattaaagagcatttgagtcactgcaggtgatgtctaaatgtgttttttttcttttctttttttttttttttttgagacggagtttcattcctgttgcccaggctggagtacagtggcacgatcttgactcaccacaacctctgcctcccaggttcaagtgattcttttgcctcagcctcccgagtagctgggattacaggcacctgccaccacgcctggctaattttttgtctttttagtagagacaggttttcaccattttgggcaggct

SEQ ID NO: 13765 - DNA, 1120 bp, Homo sapiens
tgaccagctgagttttgtcaagctctgcataagagtagcaggaatgttcaggtgaatgtgaatattccctatagtggggttgaagtttgattctgaaaagatctaaaagcaactcatggcctggcatggtggctcatgcttgtaatctcaacactttgggaggctgaggtgggcagatcatgaggtcaggagatcgagaccatcatggctaacatggtgaaaccccatctctactaaaaatacaaaaattagctgggcgtgcctgtaatcccagttacgcgggaggctgaggcaggagaattccttgaacctgggaggcagaggtcgcagtgagctgaggtcgcgccactgcactccagcctggtaacagagctagactccatctcaaataaataaataaataaataaataaataagtaaaagcaactcacttgggcagaggtccttggagctggcttctgcctgtgattgtcagtctctggtacctttgtgtggctgccacatgctggtctctgttaaaatgtcaccttctcagcaaggcctttcctgttcatggcatctaacatagccattccccctatgtcgcattctctagcctcttaccacgtttgttttctcttgtctccctttgttgtttaaaatattaggttggtgcaaaagtaattgtggtttttgtgatgactttcaatggcaaaaactgcaattacttttgcaccaatctaatattttttaacttattctcctctccccctattcttacatacagcccttcttaaaggtaagctttgccagaccagaatttatttctcttgttaacggcaaaattaggaggtcccagaatagagcttgctctacagttagaagctcaatgaatatttatggaatttcagaatgaacttacttatacaactttggtcaaattaaggatttccttaactgtcaaatgatgagtttgttcagcacttctagagttttaaaatgtacttttatattttgaattgccacttcaatgtgcatagtagattaacatatatagatatccttttaaatctctggatcacagaattagaataatcataattcttgattcaggaagcattcttgttatgcagcattcaag

SEQ ID NO: 13766 - DNA, 1156 bp, Homo sapiens
ttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctactttttttaaaatgtagctagtacaactttagtagacattttcttttgcaaatcattatctataaataatttatatcttcctgggtgagttactcattgcaaagtttgactcatgcaa

SEQ ID NO: 13767 - DNA, 1494 bp, Homo sapiens
tcagattttctccctgttaattctgtatcttgagaggtttcttttttttttttttttttttcttttcttgcaaatgcattcttttgcattaagatggtcacaaggtaaagccctgtggcagaacctggtactttaccttaccagaggaaattaccttagaataagatggagcgagaccccagctccccttaaagacaagaccttgaaatcaaatggagtcagctatacctatcaatcaatcacagttcttggatataagaagcccatagactctcttgtttacactgtaggctttttcttaatagggttgcatttgtcagtcattgcatttacccttcttggcctggaagtagaggagatcaatgcgtagctttgaccacttccagccacagggtactaacatcagacataagttgcaaccaggtcacattttaggctgagatggggctaactgaaagtcagtgtgatgaaaacccaagggcgctattccacatgtctcaaatgattggcaggggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacattttgtgtaggattgatcagattttaaatacagtgaaacttcattatatataatagacctagaccctcccaagcattttcccatcccataaagaattaatgaaatgaaatgcttatagagcaacgattcctgctcagaaaaatttccttataaacagctccaaaccaggggtgcctgagctagattttaaagttataaagaagtttcattgtatttttaaaacctttttaatgggtgtatttggacaaaaataacccccttttcacattttatgatgtgcaggtattacattgctttttacatgtggaaaagtgagcctgcatttatttttaaatgcagttattaaaacatttttgtattccccatcaatgaaaattttcagtgtgaacaaatggtgaatcataagacagttcagtgcttattttctgtaggttttagcaaaaaaatttataaaccacaaaatatttatacatcaggatggtaaatttacatcataaagattgcagatttaatattttccattgtctctgttctgagtgccatgcttgtaacattgataggaggtggacactaggcaactggtattagaagttcatttttttactgaaaaattcaggtacattagccatttgttattttatagtgaaccgtttcaatgtttgtttattgttatttgttggcaaaataaaagtgccttaagttaaaagtttgttttgagatccattaaataaatc

SEQ ID NO: 13768 - DNA, 1116 bp, Homo sapiens
tatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatggtgagtagagatatcagctctctccttgttagcagtcagaaaagcaaagtgagcaactatatctgactacaagctattcatttagtaacctttttaaaaaaattgctgaagatatgtttgttcaggtatcccagacaatatataaagaagttactttcacagaagtgagggtaactcctcaaatggttcagattgctcctactcttggcctaactcttaatctgtcttattgtggatgtagggtttctgaaatctctgctttgtaaagaaccacctgtctccttttcaacttaacgatattgccattttcagtcttcttatttctgtgtgccatctaatcagccattgttttcctttggtgtgttcttttgcacatcaaggctcttctttacatatatcttgcttttaacaataacatgatctggaactatttaggagaattgttcaacaaaattgttcttagaattagctacaggattttgagtagtatactatctagattgtctgaaataatattgtggcataaacataatagtaacactagagaagcttgactatgccattatatagacaggagagagacagcagtactcaaggagttagaaattggatcattaagaatagctactaaactatattctcaaggtaaattttaatgtgatctagtagctgattttaatgagcccattctttgttctttgcttacctgttttaatgttgtcatttttttacataaatatatgacttaaatcaatgaaatactcattttaaaagtcactgtgtagtatttcataacacagtgaaataatcacgagagagatcttttctgtgtttatggatacttgagcaaaaatacaga

SEQ ID NO: 13769 - DNA, 1589 bp, Homo sapiens
tgctgcactccaaagaatgcaaattttaatgtgccttccaataaatgcaaggaaaccgaaagagttaatagtatcatacaatgactgggatgtattgataatgctacagtgatccattaacagcacttgttcaggtactgctcccaatcctgggaatgtgtgttacctgttatgtctcaaatcctttatcttggctgttcttctaaaagtgatctgtctgtcattgaatgctggcattagagtcatgtcacaatattagagcatactggttttgcctctaacgtcgaggtgaccatctggtctttcttgctctgtaagagtttctgtttgtgcttttttttcccttacttttattatccagtttaaatccagtcagttggccaaaatggtcttggaagaaaggatttagagattctgtaaaaaagattattagttggttctgtgtttgcaaaccagtatgtaattcccatatgaatggggaaaatgttcctgaggaattatttaattgatgaggcattcacagagattaaagcagttattgttacctccaatttatgtcttctgcacagctgattaggttggacattttaatccaaggtgctacttacattctgtttcttttgtttacaaaatagggcattactgagtagaaaatacattccaggtctaagaactgtttgttctttagtggattttaaagaataagacattaaattaagaaggaaaatctgtttgattcatcattttgagtaatgcagagaataactcttaaaaaaaaaacctgaaacagaaactttcaggaaaaaaacaaaagaaattaaactactgaataatctttcaaaagcatcgttgaacagtgagcacatgtgatgccttcccaattaattaatttgggcaaaagctctagataaacttacaccaattgttgcaaggcattctctattactgcatttttaaaacaaagtcctcccctaaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaagtatatgattcagtgaattttgtcaaacatatagtagtgtaattaccaccaccacaatcttgatacagaacttttttttccccagagatggagtttcgcactgtcacccaggctggaatgcaatggcgcaatctcggctcactgcaaccttcgtctgcccgggttcaagcaattctctggcctcagcctcctgagtagctgggattacaggcacgcgccgccatgcccggctaacttttgtatttttagtagagatggggtttcaccatgttggccagg

SEQ ID NO: 13770 - DNA, 1198 bp, Homo sapiens
tgttgaacatgtataatttttccaaccttaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcagccaacctcttggattggtttctacattttcacctatggcttggttcatttgatatttttactatttttaaaacacgtgccctttttatatcaccctgtgcctcataatacagcaattgagagcacggtctggagcctgattacctcagttccagtctcagctctgtcagttagtcagtgtcttggcttctctcctttttccttatcttgtaagatacagttggcccttcatatccatgcattccacatctgtggattcaaacaactgtggatagaagatatttggggaaaaaaaggatggttgtgtctatactgaacatgtgcagacttttttccttgtcattccctaaacaatacagtttaacagctatttatatagtatttacattgtattaggtattataaataatctagagatgacttaaagaatatgggaggttgtgcctaggtaacatgcaaatactacgccattttatta

SEQ ID NO: 13771 - DNA, 1166 bp, Homo sapiens
tagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccatt

SEQ ID NO: 13772 - DNA, 2322 bp, Homo sapiens
attttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgt

SEQ ID NO: 13773 - DNA, 1161 bp, Homo sapiens
gagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcc

SEQ ID NO: 13774 - DNA, 1471 bp, Homo sapiens
atttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgctttatgtccaaagtagcttttttctcctaattgctttctaattgcttgtgaatttggggacagggtctcttagaccattccttgtaataaagaatggctaatttctacctgttgttagatgagggggctaatctggaggacaaaaacaatgtactagctgggtatggtggctcaagtctgtaatcccagcactttgggaggctgaggcgggtggatcacttgaagtcaggagttcgagaccaatgaccagcctggccaacatggtgaaaccccgtctctactaaaaatacaaaattaaccagatgtggtgggtcacacctgtaatcccagctacttgggaggctgaggcaggagaatcgcttcaatctgggaggtggagtttgcagtgagccaagatcgtgccactgcactcctgcctgggtgacagtgagcctctgtctcaaaaacaaacaaaacaaacaaacaaacaatgtactgaggatggcagcacagaggatagaaaaaactgagatgcctgtcattgttgagcccttgaagtagccaatgcttgaactgccctgctttccaatttcttgttatttgagatagcaattaaaaaaaacatttaaagccaatttaagttggctctaggatttgacacacacaaacttgctgataaaatcatcttgacagtgtaagcttctttcgccaggccagcagtaatccacttacacccacaaagtctatacaagttatttttaatggtttatgatactaagaaaagtcagacttatcatctagtccagatagttgactcctgttagagtcaatagcacagaatgagaagtataatgctgctgctgcctgactcctttttttttttttttttttttgagatggagtcttgccctgttgccaggctggagtacagggtcacaatcttgtctcactgcaacctctcccttcccagattcaagcaattctcctgcctcagcctcccaagtagctgggactacaggcacaagccaccatgcctagctaatgtttgtatttttagtagagacgaggtttcaccatgttggccaggatggtctccatactcttga

SEQ ID NO: 13775 - DNA, 1148 bp, Homo sapiens
aaaaaaaaaaaaaaacatattcggctgggtatggtggctcacacccgtaattccagcattttgagaggctgaagcaggcagattgcttgagcccaggagttcaagaccaccctgggccacatggtgaagcaccatctctacaaaaaatgtagaaattaatggggcatggtggtgcacgcctgtggtcttatctactcacaaggctgaggtgggaggattgcttgagcccaggagccagagaccgcagtgagccattatcacaccactgcatttcagccggggccacaagtgagaccgtgtctcaaaaaagaaaatgagtattgtttacagcaagaactgaaaattgtttttaatcctgttagtagcattagagagattaagatacattaacatattttgtcattggaattcagtgaaatactgaaatgttttaagaaaaatatatttttattctttataaagtagaagcatgttaattgctaaatactttcattttgaaattgtggagtatttattatagttttatttttacagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttgg

SEQ ID NO: 13776 - DNA, 1195 bp, Homo sapiens
ttgattttgtatctccctactcttaagctgaaaatgttgattactaattatttgttttaacctacagtatgcctgtatctatattgtacttacagttacaggataacagtttcagtactaagtcctattactacttacataagactaccgaatgaagtgttaaggtctttgaaatacctctgttcttaacataaatctcaacagatatataatgttgaaattattgttctgtaatctcttgaaattattcctgtgtgtctggttatactaccaacttcatatatttatttgttctagtttccttccaatttttatggattgccttttttaaggtctaaggttttttattggctttatttgtaatggacataatatttgaattctagcagtattccattgtcactttttttttttctgtttttctaatcatgtatggcaagcttgtgtttctaaaacaaaagaacccatgaatcatgtttttaattaagatatttgtgtgttttattttttgtatgtttaggggccttcagaaggaagaagttgttttgcttacacatggagatagtgtagacaaagtagctgatggattcaaggttgtggcacgttctggaaacatagtagcaggtgaaaattctaaaaattttgcagagttcatttaaaaaactttatctgaagagtaagcatatgcttctgtatgaggtactctttgatttttcctttttcttctgatttttcttctcttttttttaaagataataatgaatgtaggattaactgttatgaagggaatttaataataggaggattatccagaagtctctcacttactggtttactggtttgctttgaaatacgttgaaaaatgttcatcctaatataagcttttcaaacataaaacactatacttttgtaactcaggaaaaatttgagaactcgctgtcttcatactatactatattcagagttacttgtcttttattcctttcttaggtgtacatagcccatagcacccaaataagtactcaagacatttccctgaaccagggttggcaaactgtgacttgtgggtcaaatctagtcttttgcctttttttaatgtccaggagctaagaatgatttttacattattaaagggttataataaaatacagggactgtgtatgttgcacagagcccaaactatttactctctagt

SEQ ID NO: 13777 - DNA, 1101 bp, Homo sapiens
tgcaaactttgcctccagggttcaagcgattctcctgcctcaacttcctgagtagctgggattacaggcgtgtgccaccatgcccggctagtttttgtatttttagtagagacggggtttcaccatgttagtcaggctggtctcaaactcctgaccttgtgatctgcctgccttgcctcccaaagtgctgggattacaggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatg

SEQ ID NO: 13778 - DNA, 1144 bp, Homo sapiens
ttagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttaaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcctggcacaatgtaactaattcctgaacaaataatacttcatttgctgtcatatagaaaaaaattagaggtgatacttgtttaaagt

SEQ ID NO: 13779 - DNA, 1153 bp, Homo sapiens
tggctcatgcctgtaatcccagcactttgggaggccgaggtgggtggatcacgagatcaggagatcgagaccatcttggctaacacggtgaaaccccatctctactaaaaatacaacaaattagctgggcgcggtggcgggtgcctgtagtcccagctactcgggaggctgaggcaggagaatggcctgaacccaggaggcggagcttgcagtgagctgagatagtgccactgcactccggcctggtgaaagagcgagactcagtctcaaaaaaaaaaaaaaaaggaagttcttagtgtgtaattgaccatcagggataaatgggcttcaaaagtgttaattgtctccttacttacagtgagtttctagagatagccctgtctttcagaaattctctgacatctgcttgcgcaatgttataaccactttcccacactactcccctccagaaatctcattgatatgtggcgaggacacgccttagctatcaccccaatggatgcttctttcattgacccaaatccagaatgtaatggggaactgaatacaagttggatgtctccacccttggaaagcacatcttttgttcttactgaagtagtttaacaccaccagatgatcaagggatcagggtatctttctggtatctttttaatcactgaaggactttgacagcagtaatggtggcattgttgactcttaaatttctgaacgtttcacttaatggcaagtgaagagatatagaatcccccaaagagtgtcaagatgctaacttccaaccctatttttatgtactgaagaggcctcagtgtctcactgaactctaacctttttgtcagtgttcctcaacactggatgcgtattattacataacctgaggagttaaaaaatacaataaccagatgtccaattaaataaaattagaatctggaggaggtagaactcaagcatttacagttttgttttgttttttttttaagacagagtctcgctctgtccccaagtgcagtggcacaatctcggctcactgcaagctccgcttcgtgggttcacgccattctcctgcctcagtctcccgagtagctgggactacaggcgcccgccactacgcccggctaatttttttgtactttttagtagagacagggtttca

SEQ ID NO: 13780 - DNA, 1224 bp, Homo sapiens
gatgaagtacaaaatgaaacagacagacttaatgaacaagccagtgaggagattttgaaagtagaacagaaatataacaaactccgccaaccattttttcagaagaggtcagaattgatcgccaaaatcccaaatttttgggtaacaacatttgtcagccatccacaagtgtctgcactgcttggggaggaagacgaagaggcactgcattatttgaccagagttgaagtgacagaatttgaagatattaaatcaggttacagaatagatttttattttgatgaaaatccttactttgaaaataaagttctctccaaagaatttcttctgaatgagagtggtgatccatcttcgaagtccaccgaaatcaaatggaaatctggaaaggatttgacgaaacgttcaagtcaaacacagaataaagccagcaggaagaggcagcatgaggaaccagagagcttctttacctggtttactgaccattctgatgcaggtgctgatgagttaggagaggtcatcaaagatgatatctggccaaacccattacagtactacttggttcccgatatggatgatgaagaaggagaaggagaagaagatgatgatgatgatgaagaggaggaaggattagaagatattgatgaataaggggatgaggatgaaggtgaagaagatgaagataatgatgaaggggaggaaggagaggaggatgaaggagaagatgactaaatagaacactgatggattccaaccttcctttttttaaattttctccagttcctgggagcaagttgcagtcttttttttttttttttttttttccctcttgtgctctgtcaccctgttcttgaggtctcttttctctgctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaac

SEQ ID NO: 13781 - DNA, 3283 bp, Homo sapiens
cagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttgtattttccctacacttctttataagaatcctatgatgaagtacgtaatctttattatattattttacattaaccatcttttttttcaaattgttttattttttattttactttaagttctgggatacatgtgctgaccatgcaggtttggtacatatgtatacatgtaaccatcattttaatatctcacacatgtaaatgcacatctttgtagttaccaatcaaatgtatgtgaggcaatgaaaggcattgagcagttacagtaaagggcagacatcaggcctctgccagtatgtacctgctgtgccttcctgcctgccctatttctttgttttcagtgtgcatgccagtcactgctgcttctggagacaggatggaaggatacatgtatgtgtacatttatggagaaaaccaatttatag

SEQ ID NO: 13782 - DNA, 1207 bp, Homo sapiens
aacaaagttgcccactcatttaactgcacgccagtagaaggtatgctgtcacaccagttgaagcagcatgtcattgatggagaaaaaaccattatccagaatcccacagaccagcagaagaaggaccatgaaaaagctgaatttgacatacataaagtgtatgctgtggatgttcttgtcagctcaggagagggcaagcccaaggatgcaggacagagaaccactatttacaaacaagacccttctaaacagtatggactgaaaatgaaaacttcacgtgccttcttcagtgaggtggaaacgcgttttgatgccatgccgtttactttaagagcatttgaagatgagaagaaggctcagatgggtgtggtggagtgcgccaaacatgaactgctgcaaccatttaatgttctctatgagaaggagggtgaatttgttgcccagtttaaatttacagttctgctcatgcccagtggccccatgcggataaccagtggtcccttcgagcctgacctctgcaagtctgagatggaggtccaggatgcagagctaaaggccctcctccagagttctacaagtcgaaaaacccagaaaaagaaaacaaagaaggcctccaagactgcagagaatgtcgccagtggggaaacattagaagaaaatgaagctggggacaggtgggtcccatctccccagcttgctgctcctgcctcatccccttcccaccacaccccggactctgtgaagcgcagttcttcttctccacctaggaccgccagcagagcaggggtctccctgcccccaccccagttccccaacccactcccttccaacaacaaccagctccaactgactctggtcttgggaggcgaggcttcccaaccacagaagactactttaaatgaaaaaaagaaattgaataataaagtcaagagtcaaaaaaaaaaaaagtgatctggactagactaggcaaattactagctttgtgctctgatacattaccatttgaatcccttttctaatctctgatatggtaacaattggaaaatggatttgctttttggatcaatgggcaagaaaaggattattttctaaagtaattacctgaatgtttggcaacattgaatataaattttccctaaaaaccctaaacttttgaagtgaaaagaccatagagcagcatacctatggacacgttactcatagagac

SEQ ID NO: 13783 - DNA, 1192 bp, Homo sapiens
ctttttggtactacagaagaggaaatccaggaaatctgcatagaaacacttaggctttataccagaaaaaaggtattctctatttactcgtttgtgccaacatgctaagagtccaagctactctaaggaagaaatactaacttttttttcctccaacagccaaactatgaattactggaaaaagaagtagaaaaaagaaaagtagccttacaagaagccaaattaaaagcaaagggattgaatccggatggaactccagccctttcaaccctgggtggattttctccagcctccaagccatgtaagatgtatttagaattaaaatgacttgggggcactgaaagtgtgtctttattagagagcttttacatttgaaagttgcatagagaaaaatgatgttaggaaactgctgctatgttctctcatggcagtcaaccaacatggaagcggaagcatggtactttgagttacatttagaaacaacttttggccctctgttaaatccagtagttaacatgttgttattatatcttttaaaagcatcaccaagagaagtaaaagctgaagagaaatcaccaatctccattaatgtgaagacagtcaaaaaagaacctgaggatagacaacaggcttccaaaagcccttacaatgggtgagtatacttgggctggaaaactggcttgaggaatcttttatgtgtttactttttaacacactaagtttgtaactaatatgtcatgattttttgaagtgtaagaaaagacagcaagagaagtagaaatagcagaagtgcaagtcgatcgaggtcaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttttaatttcagttagaaaatgtgtttcattaaccccttattaataaccaataatcaaa

SEQ ID NO: 13784 - DNA, 1174 bp, Homo sapiens
agttgaaaagggagagatgaaatgatgtgttccattatgtccagaaagagggagaaaactaatgaggggaaattgaagggtaatttgaaacatttcacaaaagttgctgaaatgtcagagtaaaaagtaacccctgccctgtaatggacttagaaactgaaatagtctaaagattaaacccacttgcaagtgaatagttaagcgcctgtgtactctcagggatccctgtctaagggtgatagtagaacctgctccattttagcatgtttgtgtatctgcctcttccacaagattaggatctccaaggaaggaagcctttattgtattaggctttacaccctcaccccttagcacacagcctggtgcacccattttctaaatgactgagttagtattttgtcctttgaaggataactttctagagtattatttaacatgaagattttctttccaaacaggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacaggtatgtcagtgttcaacatcaggctatttgatactgagttggcagcctaggtgaacctgtgatgtctgtgaaccaagagccaatgcttctgcagcatttagatactgtaaaaagacactacaagccatcaatagctgggagggccggtaattaataaactgagaaagttctgtagagctcctgctacgtgcaagacacactgtagggaattcaagtaataccactgcaagcctctaatctgtttggagagtatacatataaaaagttaacaagaaagcaatatgtgccaagacccacaggaggagtactaaaaaattcagaagaggagatctctttcatccaaggagaacacagtagaagcagaaaatgaactgaggggcagtgcgctcgggacctagcagggaaagtgactaagtcatttcagacatatttctatatgtattgagaatttttcatgatgatatttgcccgttctgaccacagttaattatttcctctgg

SEQ ID NO: 13785 - DNA, 1247 bp, Homo sapiens
catttgtgaaaggatataggaaagttttacagtcatagtctcatacattcaaacaaaatcacagtaaaatggtttcttaacagaattgtaatgaagttactattttttaaaaaaagcgggcaattttctttgttcatttgtttattaattcagctatttgttgttacctactggaattcttaatatagctacaagcttccatggtttgctcatgtctacttctccagtctcatcctggaccactctaacccattggcttgcttttttagttccttggtttgtacctgtttttccatctacctgaaatacttacctcttccctctctcccagatgaatttaggcttattattaaagtttcagcttaaactttatatctcagtgaaacattcctgacacctaacactaggttataacagcttctctcaaagcatcacaaacttctttcatagtaatcaacaaactttttgatttaaaatgattttcatgattgtctgatgtttctctctcacgacttttatggtaaaaaaataaataagacttttatggtcagaccgtatctgttttgtataccatgtcttcaacacctagcatagttcctagcatatagaaggtgctcaaaaagtatctagctatctagctgtctatctctatcatctatctttgtaaaaatctttcaactcttgtaatttcagctattcagcatttataattgcccttaggatttttttctgatgctttgtaatatgaactataactcagagaaaaatagataaatgtatagttcaccaaattattataaagcagtattataatagaatatataatattataaagcaattattgtaaatcagtacttgtgttacaccatccagatcaacaaacactttgccagcacctcagaagcccccatcttctgatagttcctgtcagaactatcaccttctcttttattatgttgagcactttcttgcttttctttgtagtttcactatgtattgctaagtactacagttaagttttgcttcttttgaatgggaatcatacagtatgcattctctgggtgttctgtttctcagtgttgttcttaagattcatctatgtgcatgtagctgcagcatgttcattttgtgctatataatatttcattttatgaacatattacaaactttttttaaccgaaatttctgctgttgatggacttttgagttgttgtcagtttgatgctaatatgaataaggctgctttg

SEQ ID NO: 13786 - DNA, 1224 bp, Homo sapiens
ttgcattgttagaagtatgcatctcatttggttggaggggctggctgaaggggaatggtgaaagccttaggtcttgaaaaaggcatgtcaccatgaatgtaacatctaatttagcaagtcccctatcaagtttattttggatgaaaacaaaagagtaggataaaagcatacaaattgggcacaattcactttcaatcatcaaaagactttatttaacccctggatctgtgatcttaaagtctctacataagaaagtttgaaacagcgtttaattctaaagatgacaatatcacctttgaaaagattttttcataaagctcagtgtaccctccaaataatgttcaatgaatgtgaatttcattttgaggcagattactgcaaagcaattggagacttaatacaattaagtattgtttttacttatacattagtgaaactgcaaaatgattaacaaattatataagactaagaaatggtatttcacttttaaatcaagatacagattgaaaatttatacctaattctgttatctggtacagtttcaaaataagatctactgtgtcacctctaaaagactgttagcagttaaaattctgtcagataaataagggataatctcaaatccagtagattttcgtaaaatgaaaacaaacctcgttagtgattgctgaggccttaaacatttaattcaagcctttagcagagggtgcacatcatttaaggcagtcatgtggtagcggtgtttgggtggctaaaggccagcgtcagcccacagtgcttttattctttgactttgattgtcagtttctcttgctgtttgtttcccccttcattttggtcaaagggtctgataaggatttgtcttaaaatgtaggcaatagagtcttggaagatgggagcttttgttggtccagatcagagtagcagatgagaaacgtggcagccttagtagtcttttgaatggtttctacagtttacacttaaggaaagtgctgccccttacctagagcgtgttcccgttttcttgtaactgtgtgcgtaaaaactttgtctctgccttaaggtgaaaacagtcccgggctgtctccagagactggagtatagacattcccccagaaaccttaatatctcaagaccagataccagcagtgtgtcctaaaacagaaggtgggtagggggtggcacggagtgtctgcacccaaaggctgagaccgcgggtgagtg

SEQ ID NO: 13787 - DNA, 1172 bp, Homo sapiens
aagagtagtgagcagaaatcttaatctaaaggaattaaatggctaaaatgcgtctgtatttttctcaaatattttccaataagcagtgctaaaatatctactatgtttgttttcaggtccctctaaatgatatgtttggttattccactgaacttaggtcatgcacagaggtaggcaaatttaaacttacccttcaaaagaccaccctacagaatgatcatattataaaatcttgaccttgtatgacttttacttgatagtttaaaaaacaaacaaacaaacaaaaaaccctctcttttttttaaatccctagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaac

SEQ ID NO: 13788 - DNA, 1100 bp, Homo sapiens
acctggagataactggaaaagtcagtaaatctatttaagatactgttgtggccacaaaagagcctccagcaagagggctggagtaagctaacccagaagaggtccttgctgacattataatctccctgcctgtttatgtgaggcttcttagtgagaagctgagtccagttcctggcacagaaaggcagaggggggaaaccgcacctgtggttgatattcacatggcccttctttcattcagcacaaaggtattgaatccacattgcacttaatgagacaagctcccttacctttgagcagtctagtagtggaaatagttatgggataaaaaccaatccaaaatctaatcaagtcatccctggtggaaaacatctctgaacacaaatagtatatggttcacagatactaatatttatagtgaagtgttagcctatgtgtgaagacttttgaaaatgaaatgtgtctttatatttcttccattgtagcatgcagtccattcagaatcttgggttggccatcatttccatcattgctggtatgatactggattctcgggggtatttgtttttggaagtgttcttcattgcctgtgtttcttgtgagtattccgtatgacaacattttgtttcttttactacataacagaatgttcttatttttacttaggcatagctcccagatttgcctaattctcacctgtgaattagaatttcatagctggtgactttctagccctctgaagattcacaggcattttttaggagattcctatccttaaaggcagtgattgagttggtttcatattctgttttaactatttacagtttaaaaaaaaaaagcattttcccacttaaagtggaacaatttgaagagtcctgagtatatccttaatgtgactatgtggaaacgttggtgtgatttaggtgtgagtactcatggttattcattaggcagttttaactgatttttatttttagtccgtaatttagtttttacctgtaatttcattggtttgaaattggaagcattaggaaacttgaaaaatatataaaaataatagcatttgtccataggtaatctttaccctacatataaattgt

SEQ ID NO: 13789 - DNA, 3096 bp, Homo sapiens
acatccatgtgatatgttgttaaaaccatgttttagaaggatttttaatgtcatagatgcttaacatgccgtatgctaagtaaacaaaagataaaaatgcaaatataatatcctaattttattcaagaaaaagtatgctgtcacatgcttgttttaaacccaattacttatgtataatagaaaatatactactagaaataacctcatattaattgaaacctcagaatattaattaaaaactcagaatatttttcaaattttctacattgatcttttgtgacttttaggatcaagaagagttaaaaaattgctcagaaaaaaaatgtgtagcttagtatttgctattacatgtcttgtaatgcttggttttcattttataaggcaggtgagcttcatgtttttttcttcctctttggtaatttattgcgttatgttttgcagatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagtacttgatgtcttcttttgattttaaaaaatacaaaaacactgattttaacttttattcatgcagaagattatctagaagaaaacccaagtcagaataaagagaacttgcccaattacagtcactgaaagattatgggggtagctttttctccagagtagaactttaagtaacatatgtggttttttttatattaagtaaaatatgagtatgaagcttctctgacaaactttaaatactttttaatatttttcagccttaacatattatttgttaaagtcaaagaatgcagatattttagacaagatattaaaccaatgtatttagctgattatattgtttaaagcacatggcatgatattgtaagtgtaaatgtttgggaacagattgaaagtacgttccttatgcaaggtagcttggcagctttatttacatctgtttttctgacttacagtttattgtgttgatatgacttgtctctgtgtccctacccaaatctcatctcgaattgtaatccctatgtgtttgagggagggacctggtgggaggtgactggatcatgggggcagtttctcctatgctgttcttgtgatagtgagggaattctcatgagatctcatggtttaaaagtgtggcacttccccttcacactctctctctctctcctaccaccatgtaagatgtgccttgcttcgcctttgccttcttccatgattttaagtttcctgaggcctcccagccatatggaagtgtgagtcagttaaacccctgtaatttacaaattacccagtctcaggtagtatctttatggcagtgtgagaactgactaatacatgtgtcattattgagttgttagttctttaggctctgacgccatatgactgtttcagcacatgggtgttgaatacctcacaagtgggggagagtgcaggaagtccacactacttctgctggaaggcccatgtggcctggcctcttgccttgtctctccaccgcctctgtgccccagccacagtgagctgcttacatgttttcaaatgggttgtgttcctttccctcccagcggctttgtccacactgttccctttgcttagaatgttttctccaaggctctctagaacctgtttttacctgatttataccagaaaaccttagcccccagcccagaaccattcttcctcatggaagctcttccagatccttcagggtgtattgggttcttctaagttgctgtgatcttgcagttttcctttttagcttacctcaacttaaaataatgaagaatctctgataatgtgggtgtgggtgtctctctcttccttaaattggaagctccttgagggcagggactgcgtccgttttgttatcgatgattatattgatagtgcctagcaaaagtaggcacaaaataaatatttttttgaatgatatataaaaagagtaaattagaataacccttttggaggatgaattggcaatatgaataaaaagacctaaaagggggatggtggtgggctaaatgccttttggcttagcaattccatttctaataacttgtcctaaagaaaccatcagacaaatatacatgtaaatatattttaagaaagcgtcttcactgccagattttataatagcctaaagtataatagaaagccactctaatttacaataataggggatttgttaagtacatcatattacatacctaaagtgaaatattaagtagtcattaaatggttttgttagagaacatattgacatggaataatgttgatgacattttcacacggaagattcatagtggtgccatttttataaaaacaaatatatctgcatgatatgtacaccagtgtctctgaatgatgaatttctattggcttatttatgttttctgattttttttcacaatagctcttt

SEQ ID NO: 13790 - DNA, 1442 bp, Homo sapiens
aaaagtgtgcgcgctggtggctgggcacccctttgctaatttgagggttagttaccggcaggaagtctggttgtgcgagaggaaaggcgggcaggagggaagcctcaggctggtgctggctcccgcccccaggcctccttgggggacgcacctctgacccagcgggcgcagggtgcggggcactgagccggggcatttggggcgggtggcgggaggctggagcaggcttggcccagcagctcactctctacctcctccccctaggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgtaagttggccggggtgcgtgcccacgcgcgcacacacgcgtacacaccccgcgcacagcccgcacgccccctccctgcgctcccgcccgcccgcggccccattcattcttcctcgagggtgggggccaggccagagagcctgccgtctgctcccctggggataaggttgctcggtctgtgagctgtctgggtttgcaggatgggcggagaggaaggaggagcagccagagggcagcggaaagtcgggttagtggaaccggcgactcattttaatggaattacttatggagaccaggttgtgagtcacttgcctgaaaataaatccggggagattctggcaccaaaagtcagtgcctgcgggggatatttcaaatcgtaatagttgtggctttgtcaatcgtggtggctctcctctcgttgccactaatgtctcatccatatataggcttgttcctatgcacacgcacacattcgcctgccc

SEQ ID NO: 13791 - DNA, 1442 bp, Homo sapiens; identical to SEQ ID NO: 13790

SEQ ID NO: 13792 - DNA, 1154 bp, Homo sapiens
gattgaggtttatgtaggggaatgatgaaggttaaccaaggaatgtttactttttctgatttcatatagcagatggaattgctatcctagaggtttcaaaataatcttatcgagatgacttttgacccgtcttcaatagcattacaacaatccccgcagcctggagactaagctctgctgctgttttgagtgagctggccccacagagggtgtgacgtgggagtagagatgagtgtcggcctcaaagtctgctcccatctctcaggaaagcaccttctttagattaaggtattggggctgacactaaaatagatgatatttgaggctaagttttcaatttcactctttccagaaaaacaaagtactgatagggatctactctaaaagctggttttaaatacaaggcgttacagaagtgccaaatgcagtcactgcacttaaaatcatggcctgtggatagaaacaaagctgaagagtggcctgccgagtgtagagcgttctttcacttgtaagaaattaaatacagagacactcaacacaattcctggatgtgatttcctgttggttcatctacacactctagaagattcctgaggagaggtttattgcccaaaggaattcagtggaggtattttcaggtttggctgatttccaagagccccctctcagggccaaattatccaattccctttcttggtgagttcaccacacttcattcattcaccaaaaatatgcatggagagcctaactactacatactaggcactgagcatacagtgctaaaaataaaaaaagataaaatcctagtcctaatgtaggatacatgcattaaacatatgaacatatgaaccctgtatttgtcagggttcttcagagaaacataaccaatagggtataatatatatataattcaccttacatatatataaaattgagcatctgtaattaaaaaatctgaaatctaaaatgctccaaaattctaaactttttgagggctgacatgatgcttataggaaatgctgtggaatatttcagattttcagattagggatgcctcaccagtaagcataatgcaaatattccaaaatccaacaaaatccaacatttgagacacttctagtcccaagcatttcagataagagatactcaacctg

SEQ ID NO: 13793 - DNA, 1154 bp, Homo sapiens; identical to SEQ ID NO: 13792

SEQ ID NO: 13794 - DNA, 1148 bp, Homo sapiens
tatagccttttttaccaaagaccaacaaagaggaaactgttgtcgttgagtgcagtgcgacatcagaacatcactggatacatgagatcctgtccacgcaaagaacctacgtagggccttggcttcgagtcaatattttgttatgtctgttcacttcaggaaagttttgaggccaagaatcaaagacatatttcaaggttgttgtaaatatatttcccattattaactatactgctctctctgtttatgctaaaatctattttaaactagaccctttttctgttacttgagatttatcaactcaagtagcaagtcacattgagggagggaactctgagctgctctgagagaaggctcagaggatgttgtagcccatctctaagtggatgctagctggcatgcatggaaggctcaggctgctctttttccctttgcagagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttgtaagcagcaaaggctgaaatgcaaggaagtgtttgggagccagaaatggttgacactgtcccagtcctttcccagaattatgcaaacttgtgtttctctaaggcggtttgtaaaaagtcctgtcattgagaaatgattaagtttgtttctttttccttcctactgtaggactgaaaaatacagaagcaatagatttcacaaaagtaaagtttgctgttgattgatgtctactgtttcttagcaacaatattagctgccacgggaatatttaaattcctttgaagcgatctcaatctaagaacctattggtcttggcaaacttactattgctataattgtcattctcatatttcaataaagacaatatcacatagtgaataggagtcctggactttggagtttaagtctagctctgccattgacctgctatgaagttctaagcaagttacttaagtctcagttttctcatctataaaatggggatgataatgcctgtgtcagagtatgattgt

SEQ ID NO: 13795 - DNA, 1148 bp, Homo sapiens; identical to SEQ ID NO: 13794

SEQ ID NO: 13796 - DNA, 1148 bp, Homo sapiens
ggaacaaattgatgtaaaaattacccaacatgattgcttctgcatcttgtatcgggacttccaccttattttcttaaagataaacagtttgatcctattcatttgctctcaaagaaagcccaaaccagtgaatactgctagatagttgtgtaatagataaacagataaatgtgtttcatcaggatttacataattttagatgcttttcaataattcaaagttttctgagttttgcttatagttcatttaggttttaagcttcatgttgttttcataaaatgaaaacagttctttcattttgtgctcattagaaattcaagctgcatattcataaacttatacatattttgtattttgttgtgtacccttttgttctctttaaaaccatgtctacataaagtttttcaattaaaagaagtttttaaaacttgatgaatgaaatggtcctgtgcttttctgcctaactcttttttcaccccactcttcattattagggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataaggtgggtattcgtaataacctacctataattggaattttttttttttgagacgtagtctcgctctgtcacccaggctggagtgcagtggcatgatcttggctcactgcaagctccgcctcccgggttcacaccattctcctgcctcagcctcccgagtatctggtactacaggtgcccgccaccacacccagctaatttttttgtattttcagtagagaggggtttcactgtgttagccaggatggtctggatctcctgaccttgtgatccgcccacctcggcctcccagagtgctgggattacaggcgtgagccaccacacccagccctataattgaatttttaagtgctaagtgtgtttttctttttggattcaggctttttcttaatggttactcagtgaacacctgatgggttttgacgattattttatgttctggggttatatgattataaaaaattgtttgacatttgcagtgcctccactaaagga

SEQ ID NO: 13797 - DNA, 2319 bp, Homo sapiens
accctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatc

SEQ ID NO: 13798 - DNA, 1175 bp, Homo sapiens
ccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttg

SEQ ID NO: 13799 - DNA, 1342 bp, Homo sapiens
ggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagcacaaaaatgtataatagcaaggaaaagacatttttaaattccggttatttttattgtctaaaatgaaagcaacagtgttttgataaagatgaaaaagaaaagctactaaattagtaaatcagtggttacgtgccctgcagaatttc

SEQ ID NO: 13800 - DNA, 1218 bp, Homo sapiens
ctgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatata

SEQ ID NO: 13801 - DNA, 1122 bp, Homo sapiens
aaaaatacaaaagttagctggacgtggtggtgtgtgctacttgggaggctgaggtggagaatcacttgagcccaggaggcagaagttgcagtgaaccaagatcgtgccactgtactccaggctgggcaacaggcagagtgagaccctgtctcaaaaaaaattatatatatatatatatatgtaaaatatacacagaatattctcacaaccacttcagctaaaggaaaatttgaaatgctaatctaataaatcttaggaattaaatctgtataccgttcttgaaatagtataacttgtttttatgactttaaatttgaggacatttgattgatgtcctcaaagcattaatggaaaaagttttaaattaaatattaaaggttcttctttaaagaaaatatttgttattaaacaaaaccaaaagaatgaaggagtgtaattgttttatcaggtgatgaatggtgctatccttcaacaagtgtttgtggtggattatgttgttcagtcccaaatgtgtggagattgccatagagtagaagctaaggatttctggaaggctgtgattcaagtgaggcaaaaggtaatgagagaagatgatgagtgagtcctacatcttatatttcgtctttgttaattataacttttccttctttctaaatccagggatagtctgggtccctgaagcattcacctttggaaatagatcattattacattttagataatctttaaagattgttattgtttgaaaaatcagtatgctctatctgtagatagtatgtgtgtcctatacctataaatggcttttttgtggggcatttattgatcaaataatttatattttagactttgcataaaaaaactttctactatctggaacagttaattctgaaatatggaatgcatcagaatacacttcgtatcaaagagattcatggtgagttaaaactcaaaagcatttgaaattatgtcagatttttatttcaacatacctaagtaatcttatatttactgataatatctggattagtactgtccaaaagaactttctgttaggaaaaaaaaaaaaaacaacttaattctttatctgcactgtccagtatggtatagtcactagccacattt

SEQ ID NO: 13802 - DNA, 1125 bp, Homo sapiens
attgggatgttgtttctgctatatatatattatatatagcagatgtactatattatatatagcagatgtagagaatgattgtagtctacactagtagatactttaaaaattaatttgataaagatttggcctctctagtggtttactaccaggatttctaggctgttttgtctggaccctgattttctgaacccttgtgtcaagcaagagtttgcttggaatacgttcttgctttaagattcccctaccttttcagttattttgttcactctgcctatgttggcccatcttcctgtgaaaacatttcttttgaaaattctacatatatatatttttagggacattattaatgttttataaaagtcttgaataaaatcttagaaaaagtcaatgatttatttttatgaattgtttgtgagtctttctatactcatgattcagtaatttgttaattttgacagtgtttcatacatcagaaaaatacaaaaaattttctgtctttaaaaattagaaaaccaaaaatcaatattgtatttaacttttctctgagatgcttttagagttatgtttagattattgaagagtacattttctttcctcttaagcataccctcggggaagtctgggtacagaagacatctgaaatgaatacagataaacagtatttttgtcgtactcatttgggacatcttctaaatcccggagacctggtgttagggtttgtattatttcatattttaaactgccaattaggattgcaaattttctttgggaaccagcaaaactacctaaaaatactaacattgtttattctaaaaagatcgaagggttcttaggagccttataactcattttattgttgataactaaattaaactgggttggacagaagcccatagttactccattttggttataatcttaaagagtaatttgttgtaagattttgttaattgagccttgaagttatatggttgtatccatatttagaactgcttttgcagattgggtcttttttattgtgcagttgctactgctcagataactcacttttaagatatgacaactatatatatacaaagggcttgtaaaggcatagatcagttctttctgaatcagagtttt

SEQ ID NO: 13803 - DNA, 1141 bp, Homo sapiens
ttgctttcgcataaaacttgcaaagaatatttaaataattgtactgatagatacttctgaaagtaactgttttaactcattgaattttttttctattgtcaagtcttaatttatctttctccctctcaacctctctctccacctctccctcacacacactcttacttacacacatagcatatttatattatgcattctttgttataattctttgacattttaacatctctgaaattagggagtgtcttacaactggtgacacagaattacataactataatatatttatagctttcttatgtagttcattttctagaaatatatggaaggaaagtgtctgtgactatattatgaataatttccatctcctgggcccagagggagatcgaatatgaagggaaaatctgatgaaatatgtgtatttaatcaattttcaaacagtttgaagtggctcaattttaaatggctgattgataatggtagttatttccaagttggaataaataactgcctgttggcttcagagacaatagtgatgctcagtctgagatactgtatttgctttttttctattacaaaaatgacaggccagagaaacttggggggaaaaattcttctgctattttaagatgctgtccctctcactgtttttgtgccatcattaatcaactgtctgcatatgaagaagaaaggaaaaaaagcctgtagaccacttaatgtgccttactttagcacagtgcaaagaactcagacttcctgtatgtctacctttgtgagcatatccacataataaatgtgtcttggaacctcagcctgatatttttcaaatcttgaaaaatcattgaaattgcctatgtattcccacaaggataatgtgtgttagctattaccaggaaaatatgttttattacacaatagaatctgaaaatatccactgtatatttcaagtgtatgttactaaattttaatttaaatttagcagaatgaaaaatgatggtggtagaatgttcatatatagtgtacatagaagtttgcatttcaaagaccatgtctataatttaggctatatgatcagtagtctgatttatatctttaataatcatattatttaaaaattatttaatactttattctttacaaa

SEQ ID NO: 13804 - DNA, 1177 bp, Homo sapiens
ttatcttggggccattctcatagaagattttgctggccagttcatagcctccttctttgttctgtttgtgcatctggcattagttgagctccacccttttccccaagcccagcacgtgtttattcactgtgttactggtgcagaagagctggctcccgaagtcctctgctttctcacaaacaagcctctgtaactgctctggaattgtcctaacaagggaagaagagcatgtccagttttaattttgtaaggaaattgatgtcttccccctcccttccctgccgcactgttagcaggcatcagctcatggacttgtgctcatgtgctcacgtcctaccaggaggtccctagtggggctttgaggtttggccgagctgttctcctcctagagcagggcacacatcctccgctctcagccacgtgtaatccttcctgtctgcttgcaagttgggcacaaagtactggcgcttgggcccaccctcttctttagtagcaattaacctttactacagagcttcctttgaagtttgctcatgtttttattacaaaactgcaatgaggaacataatggggggaaatgtctaaatttctgagttacctaatctgttcaattccctagttgagctcctcttggcagttgtttcatgtagttatgatctcaaccagtctgcctgggatctcaaatcatgtttctgtctcagcctatttttaagattagggagctattacacacacacacccctacacacagattgcaaatacacatggatgtgtgtattatatgcatatatgtgtacagttgagtataaataattaacttcttaataactacagaaatcagtcttactttatagtcaaagtatgtatatatgctcttaatattaaactttttagttgctgaatattttctatcaatgaactaatgtgaagagtagagagaaaaattattcatgttactatcactaatgataatgctgagtgataagtattatgatgggcattaatggtgaaactcaggattttgaatggcatctgaccagatttgcagttaaactaggcggaaaggccaaaagaaacaaatggtgagttatataaaacccacaaaaagagaaggcatttaggccagccttgcaaataagaaccgaagaattacgagtgaaatggcatttttttctag

SEQ ID NO: 13805 - DNA, 1203 bp, Homo sapiens
agtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatctgttaacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactggcctatgagcacatttaagtattatgcaacacctacctgagataactatattagagttgttataaataccgtggttgagaatttttatttctgtgttacaaatagtcagtgaaagttttttgactgtatgaacatcatatttcttgcttacttgtgttatttcttctgtccaacttgtgttttcataggaggaaactccaggaactcctaaaaagaaggaaactaagaaaaaattcaaacttgagccacatgatgatcaggtttttctggatggaaatgaggtgagagtaagcctataactagaagttcagttttctataggagtttttagaaagatgtttgatgccttcactaataaaaggaaaaattttgagaaatcta

SEQ ID NO: 13806 - DNA, 1102 bp, Homo sapiens
agcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttt

SEQ ID NO: 13807 - DNA, 3610 bp, Homo sapiens
aagttaagattaactggaatggtgacaactggtgtcttttttattcgcagtcctcagttttgaactcctttttggctctaaacttgcttgtgggattatcggggttttttaaattttcagtactccattcttgattcgtctagaaaatctgggggattaatctaaaaatttatagatttcctttcagtacaattagcctaattacttgatttttaatcttattttaccatttaaaggttgaagaaatcttgattatgatgaaaataaatttatttttctttcaacagtgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattgagagtggatcatttttcatatgtagtatgtcagaaatttgtataagaacaaagatgcatcaaaatttgttcaagaaaaagtgaaaatttcagagtttggaattttgctgtacttaaagcaccattctggtagaactgatgctgtcgtatttacatttaataatgttacatttagctggacatagtggctcacacagcactttgggagactgaggtgggaggatcacttgaccctaggagtttgagttcagcctgggcaatatagtgagaccccatctctacatacagaaaaataagaaattagccaggcatgccggcaaagtgcctatagtcccaggaggctgaggtgggaagactgcttgagcccaggaggttgtggctgc

SEQ ID NO: 13808 - DNA, 1192 bp, Homo sapiens
agggcgctgtagttgacgggagccgcggggaccccggagacccggacgcccgtcaccgcccccctcccccagtccagcagcgctccgcggggatgccctggtctcgacccggtccgtcagcccccggcggcgcagggatccgcgcccggcgcctaaactgccctggtgtcctcttcgttctggcccggggctggcgcggggaggtgcagcattaggggcgctgaggtgacacccgagaacttcccagggagagggtgcgcgggggggtggatttccacagtccttcccgcggcccccgcgggggggcggtgttgggagggcacttggggttatcccaggctcgccggtgggggtggggggactcctccctttacttccctccacccccttgcacacccacccccaggcttcccgtgtcccttgttctccctctctccgggttagagataggtgggtggctttgagtgggcggaggacttcagggttttaggggctcccccattctaggtcatgcctcttgctctcttccttggcctgtgttgagtaaggtgtgttcctgtggtggacgaaagtctgtacgatggttggtggcattggtccttaatcctttgggtctgttttaaggtaaagtgctgagagtttgggaagcaaaaatttctatttattggatttcttttggcttttctctcaagaaggaagtggaaaaagagtcttttctttttccctcttcctccatttgcattctttgtgaggtttgtctgccttgtgctttttgtcccggattagtcttgttgaaggatggagattcccaggcgtggagtctatagcttttggcttccattaagtaaaatcgctaacctttttttaagagaaagttaatttttgcctgcagtcattccagaaaaatagtgtacacggactagctgaattaatccacttaaaattgtaacttagttacatatggtagatatgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctattt

SEQ ID NO: 13809 - DNA, 1156 bp, Homo sapiens
agtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttg

SEQ ID NO: 13810 - DNA, 1604 bp, Homo sapiens
tgcttaatggatttagtatacatgaaatagttcgttttgtaaaaagtaatttgaaaatagatattttctatgatatgaggattaaatggaaaaacaaaacaattaaaattgatagcgccttttaaatcacatagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatg

SEQ ID NO: 13811 - DNA, 3017 bp, Homo sapiens
ttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttatttcagtatcgtgtgtgagcttaactttctcattccctaagattgacattttcttctttgttcctttaaagtctattattcgtaggctgggcgcagtggctcatgcctgtaatcccagcactttgggaggccaaggcaggcagatcacctgaggtgaaggagtttgagatcagcctggccagcatggtgaaacgctgtctctactaaaaatacaaaattagccgggtgtggtgactcatgcttgtaatcccagctacttgggaggctgaggcaggagaatcgcttgaatccaggaagcagaggttgcagtgagccgggatcgtgccattgcacttcagcctgggtgacgagcgaaaactgtctcaaaaaaaaaaaaaaaaaaaaaagtacattattcgttacacactaacttgaaaaatgtgttttattgtagaacaggaaattttatgcaatatttcaggtgatgaaaataccagcattatgtgattatttaatgatttttagacttca

SEQ ID NO: 13812 - DNA, 1288 bp, Homo sapiens
tgtagtagctgtagtagctgtaaatcaagtatcttacagataatcagataattattgtaaaatacaactctagttacattagatgtagagagagcccaagaattttcagagaagttgagacttaatgagcatagtatgggtttaaccctattattaataggttgcctgttgagccggggtgggattgggagctagggggcttgatagtggtgaaggaggtgttaacgttttcacatatatatacacagataatatatttgaagagtgaaatcatattgcttaaataatttggctgtagcagtttgacaagagaatgctaccctaacaatcttgaacaatatatagtgtggcagtatgacaagaggatgctaccctaacagtcttacacaatacatcctgtgaatggaaggatgaaatattttggaggaagctaggtacagaaaagatgaatatgatgatgtatatttttcgtatagtaaacctttacatagtaggaattgtatttcttaatgaaatttatgtttttattttaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaacttttgtctcatttttttgagtatgctgtttatatgattttgatttccctctgataactatcaacagtatttaaatagcttatagctggtataattttttcccacgatttccaaaatcttttatgtactcaggtaaaagtagcgttatataggaaatcttttttttagacactctcgttctgtcacccaggctggagtgcagtgactcagcttcctaaatagctggaattacaggtgtgagccaccatgcccggctaattttttgtacttttagtagagtagggtttggccatgttggccaggctggtttcaaactcctgacctcaagtgatctacccacctcggcttcccaaagtgctgattatagctgtgaaccaccatgcccggccaggaaatcttactgtagaacaattttttatatagctgtataaaatgtatatgattgtcttgacagtctcaaatactgtttttaatagcttgtaaatgtaatc

SEQ ID NO: 13813 - DNA, 1148 bp, Homo sapiens
tagaaaacaatgaaagtccgtaactttttgacaacttgaacatattaggacttggttagaggttcaaatcaaccccggcgtgggtagtggtggtgtttttttatttattgttacatttctgtatatgtaacctaacagtacattgtacagattgcattggtacaaactttaaaattgtttatataaattgaataagttgttttatatagctacataattatttctcatttatgtagcagaaagacaggaagcccaagaggtcaacctggaggtttaatttggaccttactcatccagtagaagatggaatttttgattctggaaattttgtaagtatcattctactcggcttatttttgtaatcagagttattgataatggtttaaatatatagtatttgataataacctaagctctattcctagggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggttggtacttttgcaaattttaataaaactatagtagttttggaatatttcatagaatatgtagttattacatgtattctgtttatatgcaagaataaatatgaactttagactaaaggcctacataaatgggaaattcagtaaatgagtgccaattgctgagtctagttgtaagtgtcatttattgctagaatatgagccagttgtgtccacagtcccagtccagtaaattataggccctgtaaatccaaattgtatataacctttaatgctgagtactttagtatttgagtatgttgcaagaaacatgtctgatgtgtacataggagaattgtctcaagttatttattcagtagaggtagccagttaaagtcaaagtcttaacatcttgctgccagtttttatttgttgaatttattcaccaaatattaaatactacatgggcagcacaggactgggtaacccaacagtgaaccaagcaggcagtttacccaccaccaagaaacttctagtggagaagagagagtgaaatgg

SEQ ID NO: 13814 - DNA, 1420 bp, Homo sapiens
taaatagtaatatttatcagtaaatactcctttccaacttccttttttttttttttttttttgagactgagtctcactccatcagccaggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgttcttcctaacttgtaaaatttcacataaatatattttcaattgtgtacaaattaagggtg

SEQ ID NO: 13815 - DNA, 1209 bp, Homo sapiens
attaagagagattaggacagcagaaagctaacatgctttcttttcttaaagtgaggaagacctttggtcggttgaccacagggggcaggaagcagtggtgggggagagataaagctatgaccctgcagtcttgcttatctcaatacagagctgctccatttttctggtttctgggggcctagtccttgggagtaactttgactcctctctttctctgcactgatcattagatccatcagaaaacctttttggtattttatcttcttgaaaaatatagccataatccaactacttctcacatctatgcaactatcaactttctcctgaattattgaaagtctccgaactcatctcccttctccttccttgaccttgagtctgttctcatccagtgtctaaagtgatcctaataaagcttaagttggataatgccactgcacaaaatccaccagggtccccctctcttttattattcactagagtaagtattgaattccttgcagtaacctacaaggccctgccaaacctgacctgctcccccagcccccagcaccaaacacacaccctcctcattcctcaagctcaagccctccaggagactgcagcgtcctctcacgtaggagtgctcttctccaaatacctgcttggtctttctcctcttttgggtctttgttcacatgtcatcttttaagtgagacctcccaggacactcttttataagttgtaactccatggcgcttatcacctgacttaagtattttattcctgtccctgcccactaggctgtaaacttcacaagggtgagccatctttcccttgattttgttcgttgttatagtaccagtggctaaaacgccttttagaaaggtagcactaagtgaatttttaactaatgcgagagaaagcaggcatagccattgagggagacaaggcttagagggtaataataatagcacttttgttatgcaccctgctctgtggcaggtgctttaatatgttgttgtatttaaatcttataactgccttgcacggtgggcattatactccattttacagctgaggaaactgagcattgggcacatggttaataagcgtataagctagtagattacagaggcaatctaatatgcctaagaaaaggggatcaaaggcagaggatttaatcttagaagttaggaaggatttttctcaaataggaagaaaggaaga

SEQ ID NO: 13816 - DNA, 1192 bp, Homo sapiens
ggttgcaccagcccgcgttactccggccccacaaataattaatgggggagggagggtgtcgcttttttttcctccggctttttctcagcgcgagagcatttgaaccgaggagaaaccccaagacgcgactgaagggccattttgctgcagtgcacgaattggccacacaaaaatagagcttgggtccctatgataacaagtcaaggttcaggaacagccccttcgggttcggcccgaggagcccgcaaaagcctgggcggaaagggtgcgcgcccctcccccctccacgctggtgcagagggaccgggtcaggaagcgcggcctctccccagtccaagaccacgcctcctccgcctccccactcccccttcactcctcccaggaagcggtgatagacagttctgcgtggttctccacccccaccctccccctgctgagtggaggagttgatgtgtctcattataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggtgagcaggacgttttctggtttctttccagtggtttgggttagggtgaatgggctcggtgcgtggactgggggctggggctggggcagggggacagcagcgggagaatgcgtcggggagggaacctggattcccgttttgattcggggttgctgaggtgctcctggctgagcccctacggcaggggctgtgcggtacgtgtcttcctctggccgtggcttaggctctcccgagggctcgtagagcttatgccagtttcatcttataccggtgtaagagcattaaaatgaaaggcgtgtgtgcgtgtgtgtgtgtgtgtgtgtgtgtgtgta

SEQ ID NO: 13817 - DNA, 1142 bp, Homo sapiens
gaaataatctttcataacatttttcatgagaaagcatagaatgattttctagaaagtttaatggcaagttgtgttagatgaaaaggaaacatttttaaggacactatgcttcttgggtattcttgagcccttgtctatagataatagccggttacaatgtacagttttcatatttggaggggacatgggaaactactcacttaacttggagttaatattttggtgctctggaaacatctgagtttggaactgtgctgtgcacatctctaactggtttaattgcccagtctctcagtgtcttagcactctcagtgttttatgctcaatctctgtgtcttgttatgactatttggctcaacgtagtgttttgaactagtgattaggaagtggtagctgctgctgttttattattttattgctttactctgtgactacagacagatttaattgttggatgtatttcttaatgggataattatttaaaaacattcccagttactttaaaagcgtatgtgaatattagccatcagttttgtcttgaccttgcctttggctccttgagtgtctctgttcatgtgacagctttccagctcatccttaatgtcatactcgagctgtttatcttagtgaggtagtgtgggcctaaaatgaaataatatatatcaaaagcacctgtgggggaaagcacatctgaatgccaagcagtacttagttactgcaagtgctacttctaccaatatttttcttcctttctgcccctttaaagagaggttgtccctttttaatagatatatgacagctctgcttcctttcttaagtctaagatcaaagaaatgttgtaataaaggggagtcactccctcccattccttctctctttttgtggatgttgttctgttttttaagagcgatcaggtcttgacattagtggatgcagctgttgggctcccaagctctgcctttcatctctgggtcaccactgcagacagcatccttcatctctgtcatggtgtaaagacaccactgtgggggaacagtgcgttgcaggttaagtacatgaagtatttctagagatcctagccacctttgccgttcattgttgtttggatgcacttttctttgaaatgacatggaatgtttggc

SEQ ID NO: 13818 - DNA, 1180 bp, Homo sapiens
ctactatgagatggctgtagctttgaagctattcgaatgtgaaactttttccgctcttgcttgttctccataagacttcttcagctctgtgtctaattctccccctgcctcagtgagtgtgggaactgtatcgttgatgaacatcatgctctgcccagtggctctgtgaatgacaccattgagagctgttcaccatttctgaatttcctcatttgtctcccatcccccgcccctccatgtatgagtcagcatccagaatgtcacagggaccttaatgttacttgtttttccttatgtgatacttttgggaccttaacgttgcttttttttccttatatgatactttaagtgcatttattagacttgtttggcacactaaaacactgacctgtcattctttctaagaattttatgacaggtcctagggaatttgggttgtctcttgctttgtttagtgtgaaatgacaagaatggtgtcatagcttggttttgcaaactgaggtagactaaaacttcaaaagcaaagcatgcatatggtctctccctttaatacatactttgcatataaatgagaaattcctgttttactagcttaaaacccaggaagaggacctgttgcaaatgaagcttgctttcaaagattgtagtgaatctctgtcttggctgaaatttgcaaccagttttttgattaaaaatatttgggtgatttgaaagtaaaattattgtaacatgaatgcattaaattctgaatctttgccaacttttattatattggatgaattgttatttgactatttgtaaaatgtctgtattataaatggaaatgtttcttcctattacaagattaggattttaggagcttgttttctacataagaaactgccttgaaaaccatttctttttttttttgttttttgagacagggtatcctgtctcaaaaacaaagacctggctctgagacagacttgctctgtcacccaggctgaagtgtagtggcacgatcagatcatagctcgttgcagccttgacctcctgagctcaagtgatcttcccaccttggcctcccaaattgctgggattacaggcatgagccagtgtgcctgtccgaaacccatttctttagtatttggtggatttgtgagggattgctaacaagctgaaatgttattgtgaacactta

SEQ ID NO: 13819 - DNA, 1137 bp, Homo sapiens
tgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttcta

SEQ ID NO: 13820 - DNA, 1960 bp, Homo sapiens
gtcaaatgtaatgagcgctgtggaatggaacaaaagagaggagattgtagcagagcaagccatcaaacacttgaagcaacacagccctctacttgctgcctttactactcaaagtcagtctgagctgaccctgttactgaagattcaggagtattgctatgacaacattcatttcatgaaagccttccggaaaatagtggtgctttttataaagctgtagtcctgagcaaagagcccattttgaagtggtataaaggtacacatgttgcaaaggggaagagtgttttccttgagcaaatgaaaaagtttggagagtggctcaaaaatgctgaagaagaatctgaatctgaagctgaagaaggtgactgaattttgaaactacaccctcagtaaagcaaacaggagttgtagataaaatgtcctgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagatatagatttgaatctaatgttgcattagtcttttcagttatcttctaccgcctgtattttctactgtaataatttaagaccttccacaatgaacagttcactttattccctgggttttctataaacagttttcaagatatgatttagttaaaaaataatttattataaaaattctgtttgcaaattaaactgtaaaagtgtccaaagtctcaaaggcaatgatttgcgtgataatatggcatgcccagggccctactcatcaatgaaaaacccatatgtaataattgaattcgtttaacatgaatcttgagtatgtggaccattgcttgccattaactttttttgtttgtttgtttgttttaactccagttgtcctaaagctcaattgtttgctctctgggttttatccttagagaagccatggagaacagacttgaaaagtttaggaaatcaaaatgtggcagaggtggcgggaagaagaaagatgagattttccccttgagaaacttctgcatttagtttgtatctttccaggcaaaacaaatgggtattttttttatacaaccattttcaaatgaaccttagaaaagtcttatcatttaaggtattttatgcacagaatacccttagattgataggaaaagactcataaaggagtttgagtaaagaaaatgactgatgtactaaacccagtaaaaattgttgacaatgttaaaggtcagcttgttctaattgagaatctagatatagcttagatttcctattggcttagagcatttgctataacaaatgaagtgcaatgacaattatatattcctacttggtcatactggactggcttcattctcttaacatattctgtaatgactgaagcctttggctattaacataccctagttgccatttttaattgccatgagccaaatatttcttgtatacaattgatccatttattttcatggttgcctttttattttcagcttttcttgctgctacccatctgtgtatgtagtcattggtggtggggggaggggggaaatgtagccacactttttatagaaagactttgtgttaaaagtgaacattttgaaggtttttaactggtgaaagaaactagcctgggataatgccaccagagactgagtggaaatcgccccttttgaaggtgccattcttatgagccaaaagtttgtcatttaaaagttcattttgaaggaataacatgtcatataatttgaaataaaggtatagtaaccttaaaaagaatactataacttaatattgtgaatgggttgaatttgttaaaggaataactttgataaagttttcattcacaggcaaatgtattcactagatttctacatagtgatctgattttacttcat

SEQ ID NO: 13821 - DNA, 1109 bp, Homo sapiens
atgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccag

SEQ ID NO: 13822 - DNA, 1187 bp, Homo sapiens
aatctatatagtaccatattgtgttctcttcagagtctttgaaatgtgaagttcttaaagtttaaaaagtgtgctttagatttagggagagaactcttaaaaatcaagtgttactcagcacatattggaaagcattgtgtccaggcactgtgctagggatacagcgaacagactgtgaatggcccctgccttcttggagttgatgagctaatgaaggagcaggtagtaaacaagtttacagatgaaaatataatagtgatagtggctatgaagaaaaatgaggtgcttgaggttagacaattacagtcgtctcttgactattatgttttatgaaacttttgaattgcctggtagagtgtagggttataaaattattgtgcaaaatccagattctgtcagacttgtaaatatatttttctcttgttcctgtctcagtaaagaaccatggaagtaaattgagcttgtgtgcttttgattacaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggaggtaattcacattcttaaaaacttgtctttaaagtttagtggaatggaataattgttagaatttagataaatccctgatatagtgaatatggaagtctttgcctttaattacctttgttctagctgtagagaaaagacacatgaatagttaagcttaataatgttgcaatttaatgactgcttactacatgctaaatgctttatacgttttgtgtgtttataatagattttattattcctgttttacagatgactaaactgagatacagagaagttaagtaatttctccagggtcatataactagagagtgatagtgctgttcaaaaagcaaacaaagtcacaggggaggtcacataaattatggagaaaataggtagaatgaagtcagaggagggtgagttcactttgtgctgaactgatacagaaaggctcctataattcttccttggttatcagtatttccctttctttttgatttttagt

SEQ ID NO: 13823 - DNA, 1147 bp, Homo sapiens
ttcaccatgttggtcaggctggtctcgaactcctgacttcagtgatccacccaccttggcctcccaaagtgctgggattacaggcgcaagtcaccgcacctggccggaagttgcttgtttgttttcctcatcctgggctccataggcatggaaacctttttaatgtaatgggatacttttaaggaatattttaactgattcacttatcaaaataagacattcacatcaaacacaacttgtgacatgagttgtgtttgttgtagttttcatgttctattttaaaagttttaaaaataactatttttcaggcatattaatgaggataagagaaaaacagaagctcaaaagcaaatttttgatgttgtttatgaagtagatggatgcccagtaagtattcttctttaacaattattaatttattttcttcttgttaatgaggtttctgtggttttaatataaataatatcttggcactactttcttttaaattacaacttcttaaaaattacttgataccaagtgatctcttttgttatattttcaacctatacaggctaatcttttatcttctcaccgaagcttagtacagcgggttgaaacaatttctctaggtgagcacccctgtgacagaggagaacaagtaactctcttcctcttcaatgattgcctagaggtaaagatgtacttcacatagtataataacactactgatttttgtaagttccctgaatatttaaaaccaagctttaattgaagagtaatgtagaattttaaataaactcaagtaatctttttttaaaaaaatcgaggacaatttatgatttaatactgttaatagaatgcttttagaggaaggtctaataagaagtgtaagttttcatgacttcaaatctaagttaaaatgaaaatttatttccatgcaaataaatgcttaggtcaagaaatctgataacttcttgtttctatgtatatttattcaagatttgtaaaataattctgagttttttgaaatttcagtagattttttccaataatgatgtggttgtattttgttgaagagggagataacttgataatttactattataaattctttatgattccttgattcttcttaaatcagcaggttttagagtgaatgaggggt

SEQ ID NO: 13824 - DNA, 1237 bp, Homo sapiens
ggaatgtgatacaagctgtgaacccactcttcaggaatatgccctttgcacgtgtatacacaaaattttgcacccaatttctgttcattgtcaccctaccggctcttgatcacaggtttagaacctctgatttagaatccttacaaatgctgattgaggacaaaagggtaaagtaggagaaagtctaaatcttaatttgagtttatgtcaagaacagtgtttgtggtattggttttgtagccaactttatacttcagcattaagtttaagtctgctaaatttctaacttgtttcagagttgttagattttattttgaggtctatttccaattgctttggtatccatgacccttacaacaaattacacatttactgaatgcttatttttcactatccttaagtcagtacatttcagggtagaagttatatcaagcacatgaaaagtcttgagtagcttcatttataaatactcccatatataaatatgcttaaaagtttgatttttagaaacagttgtgtgtttttaagataacaaaaagtattatttttcaataggagaatcttatttatactgctgatccagaatcctttgaagtaaatacaaaagatatggacagtacattgagtagagcatcaagagcaataaaaaagacttcaaaaaaggtgagttttagtgaaagtattatttagcacatctctaacatattttccagactatattcaaataatattgctgcaaacaccagtataaagatagtttataaaacaaagctgttcttcggttctaggaaatgacccacagaaacaatagttttacttcagtgacttccttgccacagtaactataacttgttatccctcccgttactgtaataatgatgcttctgtgaactatcctgcagtagaaatgtactgttggtgttttagatttaaatatgtgtgcactcatcttaaatatatcgccacagttattttcagcaaagggcacacggtagtcaggggacctgactatctattcctgactctagaagtctattttagtcttctcgtgatgaagataacttacttaccttatcagagttgttgaggattacataagtatgttgataataggcttttttaaagtagcactagaattttagtgttctaagagagatttacagccatattctctactgctagatttacaagttttgttttctttcccttggtgggggggctttgtattttaataatt

SEQ ID NO: 13825 - DNA, 2560 bp, Homo sapiens
tatatacactctgacactcacatatgtacatctgagttgtacatatattacaaacactctttgagagtgtatgacttaattttagaaaattatttcccatgaagtgatttcattccttttaattctgctttatgaactaagaagaaaccttgtttgccaatttataattttttcttttataacctgaaacactgaatcattaatatttcataaaacaaagttaggtatcactactagcaataggccaatatctgttcagttgagttaatatctagttaactagtctagctatttggctttgttctcagaatgctataatagttttcttttttctcccttttccattcccctaactttaaagagtttagaattgtcagatgtcttgtacttaattgttacagtaatttgtaaaatgtaaaaataataggcatgatactgaactgtattttacaatttttttaaaggaaaatttaaaatatgaaatgtttgttttgtcttaacagggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgtattttatgtctcatgtattaatttcttcaaggaaattttcataggcaaatatgaatgcttgcatcaacatatgctcttttgtgtacttgcttgcttacttgtttattccttcctccagtaatatttttgatcattttattttacgaggctatctgtaagttaggaatttttaatctggaatctactttgagaaatgtagatagtgaatcctataatgttttatgcaaaattttgtgtttatgtgcatatatgcatttttctggcagaaaatacacaattgttatttttttggaggtggaactgttattttcccccaaaagagtggggtttccagagacaagaaatgacatgagataaggaataaagctagaaatgtattgactatacactggcaaaatatagcaggtagttaattttaatttgaaagggaatgtttctggttttttactgttatctatctgccttaggtttttagactatccttgttatcagatgaagacagtttgcatgtatcatgtgtaaaattaggattctgtatcatgcatggatattaaatataattaacttctctattgagaaaatcataatttaggtttttattaagagcacttttagtttctttaaggcatttaggtcatgcaatagtgttttttccaagaatccaaggttagttcaatatcggaaaatttatttaccaatatgacttacactgacaagttaaagaagaaaga

SEQ ID NO: 13826 - DNA, 2906 bp, Homo sapiens
aaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtg

SEQ ID NO: 13827 - DNA, 1160 bp, Homo sapiens
tttatttttcctgaccactttttatctgtgtattcttttccgtattatcagatgctgtctagatagttgtccttagaagttcagttcctctatgagccttatcttatgttcacttcccatttttaaccatacttaatttagcactagtgttcactttgctaatagtcaaaagttctatgtatcaggactatacaggtgctttgacaagtactgtgacagtctgagtgctgatgcctgaatttaacagtgagaaaattgaggctcaggtagtaggggacagagcaggaatttaggcccagtttgtgtgaattctaggccagtgttgttacctagcagtctgtcttctcaatgaatgaatggttgtaggtctggattattaagtttttatttggttgccctgagcaacctttcttattcattttatcttctgtaactactgacagtgtaatttatttaaagtactggtttcatcttgtcagttcccctgctggagaacccataatggattctctttgccaactggattgaatttgtatgcttcagtctggcttttaagaaggttccattctacctattcagctttatttctcactcttagttgggattcttgccggcctctcaaatacggtagtttttgccatactcactactttgcttttgtgcatgctgttgttccctttgtccttcttatagcctagtttcagtcccccttcttccatgaatccttttctggccatcctgactcaggatatttcttctctgagattccattgcacttaatgaagatcacaaatcccataactgtttattgttttgttgccccaactacgatgtttcttgaacggatggacctttttccttccagcatttggcagagttcttaataccattttcatgttaaaatggattgtgagggcctgtgttaaaatgggagcagtgacagccctgttccactgtaatgtggcagcatcttctttttgagttagaccttaaagatttaggtgtgctatagtcacatttaactgttcatttaaattttagtgctgccagagttgcaaaggaagaaaaatttgttagtttcttagatgaaaatggatggttttgactgggtacggtggcccacgcctgtaatctctgcactttgggaggcccaggcaggg

SEQ ID NO: 13828 - DNA, 1216 bp, Homo sapiens
ctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaattgtttggttatgagttgaagatcaagggaagaaggtaaattgtcatcactgagacgttattttgatgccgattctcgatgactgtgggttctccattcatcagtctgcacacagtctgccatggtcttctggaaatcatgcaagtactgtaagcttttaggttggcagtagaatcaacctagctgcccacactgcccgttctccccatcactggagttagcctgggactggagtgagttctcaattttgttggtagattttaatatttattttcccttcaaattttaagaaagttggccttagtaccataaacactgctggaaataaacacattattaaaaagcatatacccattaatcttttgggggtgttttacatgtaaa

SEQ ID NO: 13829 - DNA, 2103 bp, Homo sapiens
tagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccct

SEQ ID NO: 13830 - DNA, 1145 bp, Homo sapiens
gtggatgcaatgctgttaatgttcacgggccaaagggatagcagttggaactgtgccaagcaaaataaagccaaatctataaagccattctcagtggaagagcaccgtgttaacatgaattaacaggcaggggaagtctgctaaatgaggccaaaggaaagaagtcccaaagatgggtttggagaagtagaagaaagggtcagattatgttgtcatttacatgttatcttgctgaagtctgattttcaagtgagtttttttttctgtttttttgctgttgattcagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcaggtaaagggagaaaagaaaaccaggcattgagtagggtgaacatttcagggctctggctatttagcagttgtctctccagatatgactgtgcctggaataccaagatggcttagagaacaactaactatgaatttgtttgattaaaagccttatgtttttactttaaaaataagtatcactttttgtagactggatctcaacctgttacactaagctgtgtggcatgcgatagcttaccagtctttgtaggcaaatgtaaatgatctatgctggcatctgaacctgtagtcttaagaagaacaagtatttaaaccactatttaccagcctgggtgacagagcgagactttgtctcagacaaacaaaaaaacccatgatgtaccgaactcaattcagtgtaaaattgtttagaagctaatataatttgcatcatttcgaggtgacctctgtgcatgactcttatgctttccatttttgacttctaactcttatatatcctatcactggtaaggaaaacacaggtatctttttgt

SEQ ID NO: 13831 - DNA, 1132 bp, Homo sapiens
ttctaaaatatttctgtctaaaccaataccttcgtaatcttaaatagctttctaaataaaaatcataaatctaaagtatgttttactatcgaactatggaactatttttaacaccttgatattattccataaggttttatttaagaaatgtcatttgtgggatgacttagatttgttatatctcagtgttgttattcttttaaaaatgattgataggaatgtttgctgcctttgctctaaattgctgaatatattattttttatatattaaaaatattcaggactgtcaacttttaatatatatgcattcatcaaaaatttgttttaacctagcggtactttttttactttattgtgatcttccaaatctacagagttccctgtttgcaaaaaaaacatgttcatgctgtgtatgtaatagaatgttatattctttatgtaattttattaaaggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaaggtaagaaaatgactaatctactctaatcattactatagtgcagtcttctacctgtgtctatatctttgtatagtctttttttttttttccagctagatagtaagcttcttgaaggcagggactgcttatactgacaagatatagttgagtgctaaatagaaattatgtacaatcaatatttattggttgaatttttgtgtgaatatgatactgatttcttggtaaattgtctataaaacggaagaagtatgagtttgaaatttactattttttaggattcagaattagagctgattatcttttcataaataaaaactataaatagaaacattttatgaaattttgggaaaactttatacattcttgttattatatatcataaatacaccagaaaaaaataagtaattttcttaagtattaaatgcagtaattctgatcatgggtgataatatatagggagatttttgat

SEQ ID NO: 13832 - DNA, 1168 bp, Homo sapiens
cattctaattgaacatctttaaacctccattggttctttctttacttcccatagttaccaaaaacttccaccttaggcactgtcaaacctttgagaccatcatgaatcactattcataggggcagtacccatgaagtatgtcatacagtttagaatggaaattagcttggtctcaggtacttgtgacccacatatcacagttttgtgtgcttgtcataaaacatgagatttgggaatgatctggcagcccgctcagatataaacattttctgtttctacctgatatttacctagttttaattgggctgattaaaaagcatttctgatatggataaagtaatgatagtgaatacttgttgaaatttctcccttgaaaaatgaaagagagatggtgattgcatctaatgttttcctgttatagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataaggtgagtaacaagtttcaaaatattaatttttaatttaaaaagtaatcacattgaggatgagtatctgtattttttttttttttttgagacggaatctcactctcgcccaggctggagtgcagtggcgcgatctcggctcactgcaggctctgcctcctgggttcatgccattctcctgcctcagcctcccgagcagctgggactacaggcgcccgccaccacacctggctaattttttgtatttttagtagagacaggttttgcaccatgttatctaggatagtcttgatctcctgacctcgtgatccactctccgtggcttcccaaagtgctgggattacagacgtgagccaccacgcccagccaagtatctatttttaggatatacttcttgataagtaatattagtaaatagcgtttgtaagcttattcttttaattctgtgattaattcgagaggctgaaaatgttggcagttactccagctcccaaatata

SEQ ID NO: 13833 - DNA, 1119 bp, Homo sapiens
aattgtatagttcagtcacaaagtaaatacccatgtcttctgcttttaacaaatgcacacatttctgtggttttattcctacaattggagctgggtcacagggaatacatatgctcacttttattagattatgctttccaaattggttgtaacaaattataccccaatactcttagtgtatgagatttcctattactgcataaccttaccaccccttggcatcatcagtctttatagtttagccattcttatgtatagtgatatctccatgagattttaattttcattttctgtatgactaataatgactcccttttcatgtttattaactatttgaatatgaccttataaagtgccttttccaatcaatctctttcctgtttttcgtttggttgatctttgtcttcgtgatttgtaggagtcatttatatactttgatgaagacttttcttgatgtattatttttgctttaaaattttacataggtggaatgaatggctgaattatgatatatacattcctgatcttcctcgtgctgctcgactttgcctttccatttgctctgttaaaggccgaaagggtgctaaagaggtaaagtatttcagaaggaacaattatgtttacctttaaaaactcctgattataccgctgattgaattttttcacaaattggatgttattttatatttaagaaaataataataaacctatttttaaaattttaataaatgtatcatggaagaataccttgggagagcttcaggaatttatgatgaatatgttttgagttcttattgataccatttttaaaaatgcaaagtgactatataacagggattgcatgcaaatatctcatgcttgctttggttcatattttctatttataattaaaatacatgtaatttcaaatggggaaaaaggaaagaatgggcttaaaccttgaaaaatcaattttttttttttagatattcccattattatagagatgattgttgaattttccttttggggaagaaaagtgttttgaaatgtgttttataatttagactagtgaatatttttctttgttttttaaggaacactgtccattggcatggggaaatataaacttgtttgatt

SEQ ID NO: 13834 - DNA, 1170 bp, Homo sapiens
cacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacat

SEQ ID NO: 13835 - DNA, 1185 bp, Homo sapiens
aatagtgtgtttggatggttctggaggagggcagaaataatcgagtactattttgggggacgggactcttaaatgaattattcaaagtttaggagttacgaaaataagatattaaaaaaaacgctggtgcagtggctcacacctataattccagcactttgggaggctgaggcaggaggatcacaggtgcccaggagtatgagaccagcctgggcaacatagtgtgagaccccatctctacaacaattaaaattaggcaaggtggcatgcccctggagtcccaggctgaggtgggagcatcccttgaaccaagaagttcgaggttgtaagctacaatcacgccattgcactccagcctggctgacagagcaagaccttctctcaaaaaaaaaaaattttttaagccatttctagtaagaagtaaggcataattatataaatttctttccattttacagggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaa

SEQ ID NO: 13836 - DNA, 1140 bp, Homo sapiens
tactgccactgctaccaaaatccaaaattaattttgttacttgttttaacaagtgttattgtgagccttgaatggagtatatcccatcatgttttattatctgaatgaattatattttaaatacaaatcttaaaccattaaatcttaaggcagaccttacacttagtttgtttatgctaactggtgcaaagagctccatttttgaattaccaaaacctgggtttgtcttctgaatctgccacctaagatactcagcatagtgtaatggaaaagagtacacagctttggagtcagacagacctggtttgagtccaggtgctgccatttattagctacgtaactttgtgcaattcacttatctttaaaatgcggacaaaaatagtatccacctcatctgttaaaattattttatatataggtatattagttacatagtagatgttactggtttatctaactgaaatgatcattttaaagaatagtcaactagaaaagcaaagtattattcagaaatggactaatattaaacgaattttctcttgtagcatcccatatcaagatggattgcccgtaatttctatgatagtcctgaaaagatatatgaaagaacaatggccgtccttcagattgaagctgaaaaggctgaattacggtaggaaaaacgagggggtaggtgggaaagaaaatcttcctaaggtagcaaaccaccagaaaaaattaataaaactatgaatatttcagcactataggatactttatgtaaaaggataaagatacgtccagatgcagtggctcacacctgtaatcccagcactttgggaggctacagaaattagccgggcgtggtggtacgtgcctgtaatcccagctactcaagaggctgaggcagaagaatcacttcaacctaggaggcagaggttgcagtgagccaagaccatgccactgcactgcagcctgggtggcagtgtgagactccgtctccaaaggaaaaaaaaaatggataaagatagaattagcttgtttggagtgaaaactataaactggtgacaaggagactattaggagatatgtgtcagattaaagagttcttttttaaatttttgaatttttttttagagtggaagtcttgctctgttgccc

SEQ ID NO: 13837 - DNA, 1249 bp, Homo sapiens
aaaccctgtctccactaaaaatacaaaaattagctgggcatggtggtgggcccctgtagtcccagctacttgggaggctgaggcaggaggatcacttgagcctgggaggtagaagttgcagtgagctgagactgcgccatagcactctgacctgggcaaccgtgcaagactccgtctcaaaaaaacaaaaacaacaaaaaaactgtttgatagctatctatataagcaacataataaaagtcaaaaataagtcccaaattttggttatagatatataccagatgtatgcctacataagggtctgtggaggagcattatactttacataaaagcagactccagtgattgtcctttatggaaatggctcattaaatttataattggaagtgctggaatctcaatattgctgttccatttgttacagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttataatgctttcatggtttttttttttgccatgtattgttcttttttaaactacacacagacacacagacacgtacacacacacacacacacacacacacacacacgctcttttcctagatgcaatctctgggatcccttagagtccttttttggggaagtagttgcactaggtaatgtgattcctgcagagattataaaatgtgagtaaaagctaaaaatgactcatttattaagcatttattgt

SEQ ID NO: 13838 - DNA, 1189 bp, Homo sapiens
gaatttcctttttaaggcagaatgtatataccacattatgttcattcattaattggtctgtggatttgggttgctttcacctctttactgtcgtaaataatgctatgaacatggatttgcaataaaacattttgtggccgcgtgtggtagctcatgcctataatcccagcactttgggaggctgaagtgggaggattgctttagcccaaaagttcgagaccagcctgggtaacatagtgagagctcgtctctacaaaaaataaattaaaaaaaaaaaattagctgggctcagtggtgcgtgcctgtatttccaactattcaggaggctgaagtgggacgattgcttgagcccaggagattgagttggcagtgagccatgatcacgccactgcaccctagccttggtgacagagtgagaccctgtctggaaaaaaaccaaaccatacaaaaaagccattttgtattttgatcttttatattactaattttccttttttattagtgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagaggtaagttctctttctcctgccttggcctttagtgtattaaccatctattgtttgattatatttttatctgaaattccagtttcccatgaaacatttttgaggtagaatttattcaattagcatcagtcagcctagtagtcttacttatgaagctgaattgaagttaactttgtattgaggggagtgaaagatttactaagtaattaaatatgtagtttttttattgaggtttcttaaccgcttctgagtttacttcagttttatacccgttaacaaataatctatcgaagtatttttttgaatgtttactgtgtgccaggcactggcaggagtaaatggcatatattagaatagcttttctagaacttgagtttgtataatacttcgtcactggttaatcatgacgtttgcaggggtagaaaattagtaagttatttttaaaatgttattcagccaggtgcagtggcacacacctgcagtcccagctacttgggaatctgaggcaggaggattgct

SEQ ID NO: 13839 - DNA, 1147 bp, Homo sapiens
gtatcaaatgaaatcacctttgataagctgcttttgaaaatgctgcctttttaaagaaatcgttaattattgacatctgtcagtactaacattgtggtagctgctctacagatgtaattttgacttaactaaggtttcctcacttgtaaaaatgatttggcagtgggtttgtgaaagggaaccaggtttcttttcaatccaagtctgtcaattataaaagatagccttggtcttagagagttgtggtaggtgttgtgagtaaaagtttctgatatttcaaaaataagaaaattgggtatatttgtagttctttgttctctttattcactgaagtgagtacctgttgtctcttttcctgtatcctgtctacgttggctttggtgatgtgggttgtgtgctctataggaaatacacattagcagtgactattacacactggtgaaatactcaggagtagtacaagaatttctattggttgtcatgtgtaaaaatacagtgtttccctccataatgttttatggatgaagcaggcttttgaataatagtacattcttagtccaaatgaaagaaaaagagaactgaggattaaaagggaatgagaacacttgggtaagttccagagaggatttccttacacattcgggttctgagagttctaagatgaccattcccacccctcccaaatcaaagggaaaaatatctgaacgttgatttgaaaatggttcaaaacctttcacctccagaagccttccttaatcacttctctctgtcccttcagcatttatattcagtgctcaatttatactacaggtctacttcagtttgtcaatatggtctggaatttaaactatggaaatgatcatttaaaatattgacggtctgtggtgggactaaataaaacttgcaggtaggttcctgccaaggaccccagaagggtgatggatgatcactcaaaactggtatagttcacaagaaggaagtggcaaaggttctgggggaggaatatggtatgtcaacctaatctttgtttttcgaaagacatttgcttacttttagcagggtcaaggatggagttgctgcttgagcttcactgtgttaacaatgaaggttgcttttatgtgctgctgctagggctgctcagagaaga

SEQ ID NO: 13840 - DNA, 1167 bp, Homo sapiens
gaaacagtccatcaacatcaacacaacaaagctgcagtcattttgaactcagttaaggggatgaaagctcgctcttataattatttcttaacagctgaatatttgtttcttttcatttttgtttttctagtctctgggcaggattaccttgaaatgtgaatgcaagaattagcatttaatacactattttctaatgtatattttaaaaacaaggcacaggaaatgttaggaagccaagatgtctgcttactttctgctttaatttttcatcaccacttaaagttttatcatatttaattatctttgttattttccaggtaaataatattgaaaacattttatttgaagacagtgcatttttattgggggagactgaagtttatttgtcattgatatagttcaatatagatcaaacattcataattgcagtactcttaaacgaatatttcttgcctctgacatgaatatagtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggtatgtaagcacttagggaagagaaatatatatatatatatatatatatatatatatatatataattgtaaactattgttagtatatgaagcttttttcaaagaaatatgcaattcacaaattgactttttcttagtgtttactttgaacaaggtagatagctttttgtctatcttaaatgtttagttctcagatttgttatagccaaattatttgaaacttggagggttaaagtgccctttgatgccattaaatcagtacaaatattcagctggcaaggtacttagtgcttttattgtccccaagctaaaatcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgag

SEQ ID NO: 13841 - DNA, 1210 bp, Homo sapiens
gttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaatttttttaactttctactttttacaccaattgttgcaaaatagttggagctattaataggcttaggatagtatactttgctttttaaaaagcatttatacttgctcataaatagcattaaaatgtcagttggccatttaatcattttgtaatgaatcatctgaaatctttacacaagtttaggctgttagatgcataggtaattaataatacatgtgataattagcaaaaaaacctaacaaaattctaatcaaaggcaactttggaagacaatgggggatagaagggatgacaagcaatttttaaataataggccaatgatttgctttattcattctcaacttattttg

SEQ ID NO: 13842 - DNA, 2485 bp, Homo sapiens
cacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaattattcttgagtctttcatttatttggataacactgtgattatacataacttttcggggaattataatactgtgctcagccaagaaagcaaaataccaaaaaccttggtattactagtccagcatcatgtgctaatgttaactgcaaaaaagaaacggctggatgattaataagtactggaaaaattgaaatttctgtcatttctaaaatagaaactagagacatatattgtaaatccgccccctccttttctaagcagcatgaataagcatgatggggacctatacttaaaactgatttatgccacttgttgccagaaaggattcaattctgaaatttttcatgtagtttagcagatgggatattgagccaaatcagaaccaggttggctggtttt

SEQ ID NO: 13843 - DNA, 1803 bp, Homo sapiens
taagttttagagtaaatttttttctcaattaaaacataggtcctggtgagccaaacttttctcttattgttactttagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaa

SEQ ID NO: 13844 - DNA, 1261 bp, Homo sapiens
agttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatat

SEQ ID NO: 13845 - DNA, 1160 bp, Homo sapiens
gtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataacttta

SEQ ID NO: 13846 - DNA, 1320 bp, Homo sapiens
ggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatgagatgtgtatttaaactttttcatgaacattgcttatataatcattccttctgtcttaatgtactacatggtcttagccctgttcctataggattatcatgttctctgcattatagagccacctaagatgtactttttgttaaatgactcatgctggaatatctggatggggagatgttctttcctaatgtagtcatgtgccacaaa

SEQ ID NO: 13847 - DNA, 1110 bp, Homo sapiens
gggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaactttatattctagtatttttctgttgtaaaaagtattaactatttacttttattttgttatacatttattttaatatccatgtgtttattatagtaaatttgaaatgaaatcctgaaaaacagaatttttttaaacacagacctcacaccaatattaattttttctctacataatttaaaactacataaatt

SEQ ID NO: 13848 - DNA, 1180 bp, Homo sapiens
ataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaatttgttgttctgttttattttaagtatatttaaggggttgtgcaaaaaagagatggggaaaatactggatatattaatatatgtgtgtatttactggtatgtccataaaataactggaaggataaataagaaactgaaaatattagtgtgtaagaggaaaggaaatggtggctgaaggacaagtaaaaatgaaactttactgcatacgtatatgtgtgtaattataaatacatataaaatcaattttttagtctgaaacacacgaaagtattccctattcaaaaaaaaaaattttttttttctttttttgagacggagtctcactctgtcacccaggctggagagca

SEQ ID NO: 13849 - DNA, 1217 bp, Homo sapiens
accaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcacgcttgttttctccagtctcttggtgctaaggacttcagtgtggtgcagctgccgccacacctcagaggcctgttgatgctgagcacttcttgctgtggggtgcagagcacatgtggtaggtgcagcccacagaacccacccgtcccctaccctcacccaggcgcctctctctgaagctcctcaggctctaatcccagcttcacttgctacctgtgagcaactggggttccgtttcttcactgagaagtgacgacgctaccagctacaccttgtggcttgccaagagcatccgtgtttatgggtggggtgctcagtacaggaaataactgaggcacaggtgttaggattattctttcctgccttagtcccccctcctcactttccctgggagccagctgtgttcccacctgcagctcccagcatcctctagcttgatgccgtgtgctcccagcccctcaccccccctggccaacgtcaccctgcacagcgcccagatgcttgtttgttcttttcctataatgggctggtcagctctgctgcagctcagccaggaccaaccgggcctgccccttcctggcagtgctggtggggcagccgcagtggaggc

SEQ ID NO: 13850 - DNA, 1946 bp, Homo sapiens
tgtgtcctgacggcgtctccttcttttgcaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaactcttcgtgtatcaaacaattctctgggaagggagtgagatatccctgaatggctttgggacctgcatatccagcaatggagttgcatctgggaaggactggtagcaaagctggttggttgcaagggccatggggccctgaacacctggaatcatctctgtgggccttagtcccgctgcctgtgttcctggacatggtccccaaataaagctccttggctgcccataagagggtggggagtggaaaggtgagtggttgtggtgaggtgggtggtcgtggtgagatgtatttaaaatgaatagtttatcgaggattcttagcaattcaaacaatataattaccctttcagccaattcattcagattcacccattgaaaattagtaaccccgtctctactaaaaatacaaaaattagcctggtgtggtggcaggcacctgtagtcccag

SEQ ID NO: 13851 - DNA, 1124 bp, Homo sapiens
gctgttttggaaatcaaggcaaacatggttttgaaattgtatcacttctaagcaaaaggatgtttttacatatatgcgtgctttcttagaaaaaaaaaaaaaaaacaataggctgggcacggtggctcaagcctgtaatcccagcactttgggaggccgaggcaggtggatcgcaaggtcaggaggtcgagaccatcctggctaacatggtgaaaccccgtctctactaaaaatacaaaaaattagctgggcgtggtggcgggcgcctgtagtcccagctactcaggcggctgaggcaggagaatggcgtgaacccgggaggcggagcttgcagtgagccgagattgcgccactgcactccagcctgggcgacagagcaagactccgtctcaaaaaaaaaaaaaaaagaaagaaaagaaaacaatagatagtgtaaaacttaaatgaaatacattttagtaaaatctagattaaccagaatgctaaaggaatttaatcgagtttctttctcctctgcttctctggcagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtaccgagtccttcaggaactttggcttggcatgtctgggaggaaactggcccctggcagggatggactgattgccatctttgtagggttctgggcattcagataagcacttgcagcagcgctatttacttgctattgggagggatacagcctccgaatcacaagattactcaggcacctctgatggggttctcattttactttactaatttgtccttttgttgcttgtgagtagcgacactgacttaagtcagagagtacatgtacttagtgattcattcacatacacaatgatcacccctggcatacttaggccagagagtatagatacttgtgattcattcacatacacaattatcatccctggtacatgtacttagtgattcattcacatacacaatgattaccgctcccggaggcctactgagacc

SEQ ID NO: 13852 - DNA, 1131 bp, Homo sapiens
gctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttcccacttcctggtatttaatactgttgctgaatgtgccttgtgtgagtgtgtgctccggcgttgcaggacctcagctggaggtggcactcggtggttcttgggggctggccgccttccctctgcaggtggtgttagacatatgctacctgaggtaacatgttttcatttttgggagggagtcgggagtggggcgggcccatgggagggtctctggatttttgatagcctgctttgtttgctctcttctgtactattaaactgctgatgtttattttcaggaatgttttgcaaatgcacttctcactcttccccagtacaactgtaggtacactgttcctttttatcaaataagcacgtttgaaacgatccaaaaaaaaggtcttaatttcatgtaaacaaatgtatccatgtgtggagatactggaataaggtcaaagctatacttttgaatgaccatgtgtttagagttaatttcagctcattgataggtttatgttacattagaaagagtaatggttttgatgatgtcctgtaaggaagaaagtttgcaattagacctagctcctgcagaatgccctgagtaagttactgcaggcagcttgtaataattgggtcttccaaagttttgctttgcttgcgcactggtccctgagtggagctgcctactctttctaacttaacataaaactatggcattgtgtgtgagtgccgtggagatgttgacagtggtgtgtgtctctccctgtaggccttcatggtgaaacacctcttggagtatacccaggcaacagagtctaacctgcagtacagcttgttgttagtgctgggcctcctcctgacggaaatcgtgcggtcttggtcgcttgcactgacttgggcatt

SEQ ID NO: 13853 - DNA, 1084 bp, Homo sapiens
cctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatca

SEQ ID NO: 13854 - DNA, 1091 bp, Homo sapiens
tcagagctctatcgatcactgggagatgtcctccgtgatgttgatgccaaggctttggtgcgctctgactttcttctggtgtatggggatgtcatctcaaacatcaatatcaccagagcccttgaggaacacaggtcaggatgggaaaatgacaggaacaagggttaaagaccagcagagccctgagactgcttttttgcagttctgtccctcctgtcctttataggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctggtgtgtggatatctggggtcctttgagatggggaagtgacaggcttcagtgggagaaacaaattaaagtccttgtaacttctccccacagagcctgtttcagggcagtagtgatggagtggaggttcgatatgatttactggattgtcatatcagcatctgttctcctcaggtgagctctttagggctggggctgcacacccaaagagtagaactctgtgggtctgttattgtccccttagaaggccagggtatatttcttctccctgtttattttcattatttttacttttattttttgagacagagtctcgctctgttgcccaggctggagtgcagtggtgtgatcccagctcactgcagactctgcctcctaggttcaagtgattctcctgcctcagcctcctgagtagcagggattacaggcacaccaccatgcctggctaatttttgtatttttagtagagatggggtttcaccatgttggccaggctggtctcgaactcctggtctcaagtgatctacctgtctcagcctcccaaagtgctgggattacaggcatgagccaccacacctggccttattttcatttttatttatatatattttttgagacagggtctcgctctgtggcccaggctggagcacagtggcaccatgactgctcactgcagcctcagcctcccag

SEQ ID NO: 13855 - DNA, 1179 bp, Homo sapiens
ctacttgggaggctgaggcacaagaatcactttaacccaggaggtggaggttgcagtgagccgagatcatgcaactgcactccagcctgggcaacagagctagacttgtctcaaaaaaaaaaaaaaaagaatagtacttaattctagcccactccacttcccttccacaggtggcacaactctttacagacaactttgactaccaaactcgagatgactttgtgcgaggtctcttagtgaatgaggaggtgagaaaagtcttccaatgcctctttaggagagaggagaaggctatgattgtatctcatgctggtaacttttgatcttttttgtattttattgaggcttaggagggaggaaaagcaggggacaggaggaacagtacacaaagaagaatctttgtggcagtgagaggcagaggggaacttaaaaggattagaaaagttgtacttgggggcattcttcctgtctttcttgcttaggtgacctccctttccttctcattcagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgagcacaggtggggaatcaagccaactatcctaggaacaggaacctgggggggccacgtctccagaaacacaagggatggctacacaagggacagtccctgggaataaggaactatagagcggctacctcaggaaaggaggaaacagggatttgaaaacagcgataccttaatttgtagcctgtgggcctctcattggatgactcttcacattccagggtaccctgtagtcacattcaggagcaagtagataattaacatgcagtaacaacatctatttagcacattacagtttacaaagggcttttatatacattgttacatttaatcttcataatttacaaataaacaggctca

SEQ ID NO: 13856 - DNA, 1237 bp, Homo sapiens
gcatagagggatctgagggcctggtagagtatcctgctggactttccaaggcccctgaggtcccctttattggccttttgcaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgtatttggtttgtctccatccctgactaatcagccagtgaagtatgtgaccagaatcacatgatagcctttccttaacacctgggggagagggaggacgggtgtgccagccactaggtggtactgtggtaccttgctaattaacctttcccatggctcatgggtagtggagggcggaggttcttttccagcctctgtggaccaacttgtgatcctggggtggtgtgcctaagcccgtttccatagagtcccattttgaacacttttctgccagaggattatgttgccaaccatatgtaaagcccattagacatgccagttcctttcacatgccttttccagttgatctggtactcgttctgtcaggaagctgggccacgcttcatcagaaataaggaaatcagctcaaggtcacatgactcttgaggggtaaagctaaggac

SEQ ID NO: 13857 - DNA, 1547 bp, Homo sapiens
cctgtagtcccagctactcgggagactgaggtgggaggatcacttgtgcccagttcgaggctgcagtgagctatgatcacaccactgcactccagccaggaagacagagcaagaccttgcctccaaaaaaaaaaaaaaaaggctgggtgtgatgtgactcacacctgtaatcccagcactttgggaggccaaggttggcagaggataacttaagcccaggagtttgataccagactggccaatgtggtgaaaccctgtgtctattaaaaatacaaaattaggcctttcctttcagtggagcgtggcggcaagatggctgtgcaaatttccaagaagaggatgtttgtcactgatgacatcttcaaagctgaactgaatgagtttcttactcaggagctggctgaagatggctactctggagttgagatgcaagttacaccaaccaggacagaaatcattatcttagccaccagaacacagaatattcctggtgagaagggctgacggattcgggaactgactgctatagttcagaagaggtttggctttccagagggcagtgtagagctttatgctgaaaaggttgccactagaggtctgtgtgccattgcccaggcagagtctctgcgttacaaactcctaggagggcttgctgtgtggagggcctgctatggtgtgctgcggttcatcatggagagtggggccaaaggctgcaaggtcatggcgtctgggaaactccgaggacagagggctaaatccatgaagtttgtggatggcctgacgatccacagtggagaccctattaactactacgttggcactgctgtgtgccacgtgttgctcagacagggtgtgctgggcatcaaggtgaagatcatgctgccctgggacccaactggtaagactggccctaagaagcccctgcctgaccacgtgagcatcgtggaacccaaagatgagatactgcccaccacccccatctcagaacagaagggtgggaagccagagccatctgccatgccccagccagtccctacagcataacagggtctccttagcagctgtattctggagtctggatgttgctctgtaaagacctttaataaaatctcatacaaagacaaaaaaatatatacaaaattagggctgggcatggtggctcacacctgtaatcccagcactttgggaggctgaggcgggcagatcacctgaggtcaggagtttgagacaatcctggccaacatggtggaaccctgtctctactaaaaatacaaaatattagctgggcatggtggtgcatgcctgtaatcccagctactcaggaggctgaggcaggagaatcgcctgagcccaggaggcagaggttgcagtgagccgagatagctccactgcactccagcctggatgatagggtgagactccttctcaaaaaaaaaaaaaaagaaaaaaaaagttagccgcatgtggtggtgtgcacctgtaatcccagctactcaggaggctgaggcacgagaatcacttgaacccaggaggtggagattgcagtg

SEQ ID NO: 13858 - DNA, 1557 bp, Homo sapiens
ttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagt

SEQ ID NO: 13859 - DNA, 1151 bp, Homo sapiens
tagcaataggtaagcggcctctcaagctgctgcccaggtacaggtgggtgggggcctgcccccatcgttttcctgcatcctttttcattccctcaacttgctctggagttggatcctgggcaagaatgggtagcacaattccatggccccttggtacttctccctcctttgtgacttctgaagccatgctggctttgtctaacatctggaggagtcggccctccccactggtgggatcactagcgggaggactgaagaagcagtgtctctttctgtcctggacctgggagcttacagggaagctagataaagctgggaaattagggccagccctgggagtaaggaatatctgtctctaaacctgatgaacctcactttattaaggttacatcagccttaatagttgacttccctatttcttgtggcctttagacactagcccagctcaggcactcttcccatgcctccacagggagtcataagaagggaaccactccagtggtttaggcattggctttctttggagtgtgtgtgtcagacttctgcagaaaggagggtggggctgttagcagctgtggttgatccttatggggtaaggttcacctgggtgctgagcaggccctatgcactcttttccctcaggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatggtgaggctggcgggctggcacggcagcgggcgtagggtgggaaaaaaccaggctgggcctggcctgaaggtgggtgtaggtccgaggctctggtacactctgaactttctttcctgagtatttggtctcttgggctaggatctctatgcccctcagaaggccagttcacatccagacctgaaggctggtctgaagtagaacacagaaataggccagcaggtgatcttccaaggggctaggaac

SEQ ID NO: 13860 - DNA, 1258 bp, Homo sapiens
ggcaggagagctggtgggagagggtgtcccttggagggctcagtggggtctagtgaaccacaagtttcttctggatttcattcccactgtaattgcaaactctgttcctgacggtaagcctggctgttcgctcttgacattagtgctacgagagatgaggggatcgtcctcagagagcaagcccctttgtttggtccctaggaccaaggccttttctgtacatactgacagcctctgcccagtgtgcctgaaacacccaggtccctagcagaaggagccccaagagatgagcttgcaaggcttccctctcatcccaagctctggggcagacctccgagtcacaaagctgcattctagcagcttttcatagtctctggtgccagcctggggtggagtggtctcccagcatgacagctgtcattctcctgtaccaatgagacctcttctgcccctgcttgcagcgggaagcaatcaattgccattgatgactgcaccttccaccagtgtgtgcgactcagcaagtttgactctgaacgcagcatcagctttatcccgccagatggagagtttgagcttatgaggtgccattggggtgtgaggaggcagctagtgctgctggcagactggggagaggaagtgggtcagctctttggtaaccttgcttcccatcccttaaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggacagggggctcaaggaggaggaagaacttgtccctaggaataaaggtagctgatgtcacagcttgacagagctccctgacaggtgtgtcacttctaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaa

SEQ ID NO: 13861 - DNA, 2626 bp, Homo sapiens
ataacatggcccacaatgcagagcatgaggcttgcgacctgcttatggaaattgagcaggtggacatgctggagaaggacattgatgaaaatgcatatgcaaaggtctgcctttatctcaccaggtgagtgaacatggtagggaagggtggcaggcatgccctcctcagcacctctctctcaattgcgcctcctctattttcccagagcatttgctcaagcatagcatcacgctgtagttaatcttttgatgtgtgtgagtttcttgaggacagagactttgtgtcttcttagtagttctaacatctagcacagtgcctggtgtatatagtagatatttattatttattttgggtaagtgaattcatggggaaaatgagtgcctgggactttctgaattctttgttacttttacttttgtagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtgtatgtagggaagaagctggcaaagagataagcttacgaataggacacttgcataaagagctgggacttgtagtttctggttagggcttgaggggttttcctgtgcccttagtggacagtgatgagcagatgtacgggctctctccacagggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggaggtgagactgcccttttttcatcaaggccttttcgtcataattctacctgccatttcacctccctgactctacctctgactagactctccttgattagaattgccattcagtgggatagcagaagggacagctgggggagttctagggaagcaattgtgaccctctgacttctcttcagctggacatcatggagcccaaggtgcctgatgacatctacaaaacccacctagagaacaacagtgagtagccctctctgtgtatgggatttgggggattgtaggtatgccccttgtattgggagtgatggcttggccaacatgcttatcctatcgagctcagaatcctcatgaatctttttcaggtcactgcttgggggggtataggtagaggatactaagggactagctcagaaccagagaccagttgccatgctgtgtttctttcctgtcctacctgaaaccttctttccttacttttcctctccctcctgttgcagggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggtataattctgttcctgctttgtcttttgttttgctttgatcacttcttttgtcctcttggagtcataagttatctgacaagggatccaccatgcagttctttggagagctctttataataacaggatcctcaggatagggccattttaagactaatagattcttccctggtataggaatgttgagtgcagctgcatctcttgggatgattctgctgtgggatgtggatggtggcctcacccagattgacaagtacctgtactcctctgaggactacattaaggttggtctgcatacagcctgctcatggggacttccccgttccatattctagtgcctagcagtgcctctctttcactgatgaggtctgcccagtttttaactctagttaataagggtgctgcagtgaggcccatgttgcatcctttgcggtgaggaagatagagtatcctgagtgaagaatctgtttgctctttgtagtcaggagctcttcttgcctgtggcatagtgaactctggggtccggaatgagtgtgaccctgctctggcactgctctcagactatgttctccacaacagcaacaccatgagacttggttccatctttgggtaaggttcctcgcttgtctttctggtagtgctcagcctgtacactctggagaacaggaactgggcccttttcacccatattgccaagggctaccactgtgcctattgggtatctggctcttggtgaatgtttgttgaaatggtgaatgaatgaccgattctccttttgttcttttcttgctgcatcgttgggtatgtgttggggaccgcctttccatggcttttgcaggctaggcttggcttatgctggctcaaatcgtgaagatgtcctaacactgctgctgcctgtgatgggagattcaaagtccagcatggaggtgagtagaggctattgagcatttagagtaagtagggaaggtgctttgagtcttactttctgtgataaataatgaaaaagaagtaagtgtgtgcatgtgtgcatacatgtacatgcctgttggtgtgtattgaggggcgtcacctcagtgaaaccccttgatctgggattctaagcctctgg

SEQ ID NO: 13862 - DNA, 2629 bp, Homo sapiens
attaaaaatacaaaaattagctgggcgtggtggcgcgcacctatagtcccagctacttgggaggctgaggcaggagaatcgctcgaacccaggaggtggaggttgcggtgagccaaaatcgcgacactgcactccagcctagcgatagagcgagactctgtctcaaaaaaaaaaaaaaaaaagcagtgcaggggataacctcaggatctgtgaccttggggctgtcacaagggttaaatgtcaatagtatgtaaaacagttggcctagtggctggcatatagtatatactcaatgaataatgactactattgttattttgatattatgaactaatgttattagggagaatatcttgcagtggactgtaggaataggctatcttgaatcaagacataaatattttaataacttactctgtgtaatactgattttcctacctctaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctgggtgaggggatgtttctatttgggcaaagagctgacagtaactggatacaacagggagggtttatgtgtcaggctgtgctggatggaggcaagtatcctctgaccccttgaatctgtcctgtagggaagggtgaggccatcgaggcaatcctggctgcactggaggttgtgtcagagccattccgcagttttgccaacacactggtggatgtgtgtgcatatgcaggtctgtgtctttatgagtctgtcttgtgcttccccagtgactcctcacttctttcttggtccttattttcaggttgtttctcctttctccttcattctgatctgctctagattctttagacttctcctgttttccaaagcttttccttggtaacttctcatttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcaggttatatgggcagctgggcacttgcagagaggctgtgagaagagataagcatataggggaggctgggtttggtttttgctttagggcctctctgggtattgccatgtattgaaatagcgtgtgactgggttctgtatgtaaggggtaaaggtgttccccacaggatggctttttattttcagatgggacttgagtcaagggtgactgttttttattccttgagcttaatgggttctgctctctcttcaattgcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtgccttttctttcttttttcttttcttttttgaagcggagttttgctctagagtgcaatggcacggtcttggcccactgcaacctctgcctcccgggttcaggtgattctcctgcctcagcctcacaagtagctgggactacaggcacatgccaccatgcccagctaatttttgtatttttagtagagacagggttttaccatgttggctaggatggtctctatctcttgacctcatgatccacctgcctcggcctcccaaagtgctgggattacaggcatgagccaccatgcccagcctgctgtgccttttctacagaagttaaggcccccttttacccatcagtccactcctgtaatggaatttgtttttactgcattccgccttactgttgtattttcttggatcatcagctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtgagtatccggcagaagaaggtcataaacagattgggggaagatttgaagccccttttttcacttctgtaatgcttaacatttccaggtaccaataatgcccgtctggctgcaatgctgcgccagttagctcaatatcatgccaaggacccaaacaacctcttcatggtgcgcttggcacaggtaaagaatagaactcctccacagagcgtgccggggaagtatctgtggtgatggaaggaggaacatggagtgttggcccaggaggaaagatgtgaccaagtgggagatttctgtttggctgggttaggcgatgtctcctcagtggtaactcctcacctctacttccctctgtttttttcagggcctgacacatttagggaagggcacccttaccctctgcccctaccacagcgaccggcagctt

SEQ ID NO: 13863 - DNA, 1593 bp, Homo sapiens
ctgcagacgggaggcggtctggagcctcaagctaatggggagacgccccaggttgctgtcattgtccggccaggtaagtaagccggtgggacggagcttttatggggaaagggaatgttaacagttaaatgctgaggtggtggagtgacttgaactgggtaccagagaatgatgacttagatttcaggttgtgggattttgagggtgaattgggttttggatgaaagtggaagtatagcttaggtggggagaagatgatgcggggttattaagttgggaatgcctgggctggaggatggggaggaacaacagcagttaagcacttgcctttagttgctcattcttccttcctatggtgcagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaaggtaaggtgtggttggacggtagaggtagggcgggctaggggatatcgttccttgccctccttgatgaccgcccatttttgacatgtttctgggtccctgcaatggaatctaagaactagattaaggacttttaagcctaaaaagggtgatgcaaaggggaaatactgttctttggctgctttctatttcccagggattaagggtactccttaaattattggcaaagatccatgcttttatttatttatttttaattagtggcagtatctgtgccaaagaggagacggaaaattaaggagctaaataagaaggaggctgttggagaccttctggatgccttcaaggaggtaagggagcagaaaatgggaggggagagggccaagttgaggtatggagcagtggtcattctg

SEQ ID NO: 13864 - DNA, 1860 bp, Homo sapiens
ctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctacagctggtttcatgctactgtggcagaattgagtagttgcaatagagactggccctttattaaaaaagattttctgacccctggactgggccattcactacctgtttggttgcatatggtggtgctggccaagggactcagccgggttggacctatgattctactccccttttcttcttcagcctggctccatcgattctaacaaccagctctttgcacctggagggcgactgagctggggcaagggcagcagcggaggctcaggagccaagccctcagacgcaggtatggaggcagtgtcaggagctgggtggttacccgtcagagctcccttgaggacagagccttttctgttagggaggccttcagtacaaggtggttaggcaatgcgggcaatagaggaggtttgtgttgtggttccagggattgaactgctttacttttgggactgggaccaagtgtcctaaactggcaagtaggggataaaatgcaggaaaggagaaaaagattttaatacggattttctgcatccccagcatcagaagctgctcgcccagctactagtactttgaatcgcttctcagcccttcaacaagcggtacccacagaaagcacagataatagacgtgtggtgcagaggtgaggtttcctggacatctttgttattcacactgggggtaccgtgattgggttctggttgttgccataggttggaaatttcttcatacctgtcctggttggagcccttgggttagattggggcatactcattatgctaagaacaaggcccaacagttgctcagcatgttgtgtaattacatgagtgcctgggcagtgcaagtgagtgaaaatttgtctgtctgtcttccaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccggtgagagtctgggagaggaatggagggaaaggcattggctgccttgggactagctggtccccagctttttgagagctccaaatcttgtttgctgggaagactgaaaagtccctctaatctgtgttctcttcccacagtgaagcgagaagctgccctacccccagtgagccccctgaaggcggctctctctgaggaggagttagagaagaaatccaaggctatcattgaggaatatctccatctcaatgacatgaaagtaggcagtgggagcggcgtgtgattgaggagtgggcagggagggatcatgctggcaggcataggggtccggggtctgggtcagacagtgactggtctcttcctgctgtgccctgcacccctcaggaggcagtccagtgcgtgcaggagctggcctcaccctccttgctcttcatctttgtacggcatggtgtcgagtcta

SEQ ID NO: 13865 - DNA, 1382 bp, Homo sapiens
aaaagtgtcaaggccagagaaggtgtgtatgtacaggaaatgtgtggggaaggaagggaaattgagatcaggagttgtcaggatctgtttggggggcagtgaatgttcaggttacatgtaggatatatataggactttatgtatgatatatataggacttttagcgatttcctgaattcaggagtaccaattctgaatatagttttctccattaaatacatcatgggcagagaggtttcaggctgccaaggtgaggccaagcaagtttgtaaggtttttctgatggccaagtgactcattgctgtgcagcagtctcagatcatgagattagcatcctgtcagaggcctagtcactctggaatggccacaaatgtcaggctggtgcatcagggccttgtttgaacagtggaacttgggagggttccctggggtgggctggggtggcggtggccagtcacctctaactgctgtcccgcctgcttgcagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcactgcctttctgctttatgccctgctccctctagagaaggtgtttataggtggggatccttcccagagctggtactgtagcgctgttccctgtaacctggcacccctcctgcctcttcccctgtccatgattgcagggatctgaggtttcctggaaggttgggccctcagatgggcttgataggtgccttcctggtccggagaaaagggagattagtgataggacatccttgctaggctctgctctcctaccagaatgattcaag

SEQ ID NO: 13866 - DNA, 1179 bp, Homo sapiens
ttctcagccggattcacacagatcctggcccctcaggctgtcggtatgttagaagagaaggggagggcagaggcgggacccctgaaatgggtgcatcgaatgcctctcctgagactgttccctctccaggctctggcatccctgagatgaagaccatcttgcggggagtggtgctgaaagaatacctcacactcaagacctttatagctaaggtcattgggctgacctgcgccctaggcagcgggatgccgcttggcaaagaggtaactgcaggctggggaatgaaggagtccctcctggtggaagaggaggccaggccaaggtcagggcgggccccctcccgactcaccgcctgccccaccccgcagggcccttttgtgcatatcgcaagcatgtgtgctgcccttctcagcaagttcctctccctctttgggggtatctatgaggtaaggggaaccctggggcaagtagggggcagaggctgctgagcccacagctgaccccctcttgccaccactctcgccagaatgaatcccggaacacagagatgctggctgccgcctgtgccgtgggggtgggctgctgcttcgcggcacctattggaggtaggcagggctcctaggtcagtccagccccacaaccctgcccttggcctctcctccttggcccctcttatctgggtctgaggccttaggccaggcccaggcctcaagtgctggtctccctccccctcacaggcgtcctcttcagcatcgaggtcacctccaccttctttgcagtgcggaactactggcggggcttcttcgctgccaccttcagtgccttcatcttccgggtcttggcagtctggaaccgggatgaaggtgggggcacccaggggatgagggcagcccgagatggtgccaggtagggggcccacgaggctaggcctgcctccctctgctgttcttccctttagagactattacagccctcttcaaaacccgattccggctcgacttcccctttgacctgcaggagctgccagcctttgctgtcattgggtgaggagctgagggggctgggggtatcagagaggaggggggtttctagaaggctccttttcactcaggtgcctcttccctttccagtattgctagtggcttcggtggagccctctttgtctacctgaaccggaag

SEQ ID NO: 13867 - DNA, 1198 bp, Homo sapiens
ttttttttgtatttttagtagagacagggtttcaccatgttagccaggatggtcttgatctcctgacctcgtgatccgcccgcctcagcctcccaaagtgctgggattacaggtgtgagccaccgtgcccggccggtgtaaagcttttcttaaacgtttcaatagttgcataacatttcagtaagtggatatgtcttgattcatttgaacattcccctgatttggggcatctaggtgttttccaccctcgataatataaagaacagtgccttgcacatatctgtgcattgatgtttgtcagaattttggttcctagtgacaaaacagtaggaagatgcctcttctgtttcttaggctgagatggaacagtgccttgcacatacctgtgcattgatctttgtcagaattttggttcctagtgacacaacagtaggaagatgcctcttctctttcttaggctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtttgtctgtggtgtattgtttctggcccacagccagctgatcacttgtcaatgtaggatctattccagccttttggtatctgggttcagggttatctcagtctcctggctgactgttctcaacatttatcctccagtgtggttttcagtctgggagagagttgtgcttttggctcctgagggtaccccaggcccagaagataccacccatttggcgcagaattttgaattggcaaggagccctgctcatgtccttccaaca

SEQ ID NO: 13868 - DNA, 1174 bp, Homo sapiens
tgcggggtttgcatcttttgacctggtggcccagatgacggcagagtaagtgtgcctcagatttggaggagcagggcagggggccctaggctgggcccagagttgagggcacgaggaaagggactgatcctaatttggctccacctgcagagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgattctcttgccccttcttattcctcctcccaaagcaagattccctgattcagagttcacagtccctggctgccaacccttcgcaactccctggaggcattgggaaaccagatctgggcccatccaggctc

SEQ ID NO: 13869 - DNA, 1181 bp, Homo sapiens
ggagatacagagaaatagaacaaaggactctcataattttaagagagattttgaaggaagtagattgttaaaatagcttctattttaaaatatgtattgtttcagtgctaacaattgtcctctgaccagctaggtttatcggctttactttgttcttttgtttcagcaatatcagaaaaactagaaatgcagagtttgtcatgataatgaagtcatttgtgccaattgctttaaaaaatcttttataaaaaacgatatgctctaatccacctacagcttttagtcttcttttacactatgaaagtgtcattttaacattttcaaaagtcagtagtatattgtacctactgttctctggcctgtcactgagtagttcttgctttgattgtgttgccatgtaaattgttaaatggatcaagtcctcaatgtaatttaatcgagcagccaagctttcttcttgacccaaatgatgaagcgggtgtggtctcacttttgttttgttgtgtgcttgaattacagtggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggtaaggataatcacttatcttgctatcctagaaaatactttgataaacttggtattttgttatagttgttttagaaataggaactctggggagttacctttttctgtcttgaggtgtttctttacaagccactaggttgaagtgggtgtggatgtgcttataagtgtttgggaatacaagctaaaacaatcatttttcttcccttctattcagaaatgtgacttattttacttaataacaaagagttttaatttttatactaaaataatgacgtataatggaaaatttgtgagaaaaattgtaaaaatcaaaatatttttagaaagcttaatttggcagtaataagcctgatagatttaagggataaataactacagacaggtactctatgaggctttggaaatatttgggtgataatggtaaaggcttgaacaggtatggtagctgtgggtattaaaaaacaaagatggctttgagagaaagaagatatt

SEQ ID NO: 13870 - DNA, 1135 bp, Homo sapiens
aaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattt

SEQ ID NO: 13871 - DNA, 1210 bp, Homo sapiens
atggttgtgctttccaattcattgatgaagaactaattttttagtgctttagtgtactgaaatgctgtctttagtgccctggaattacttatttaaactgtgatagaaggttgtacaaggtattacttttctctgcttataaattatatgaatgtacatagtcctagcaatatgaatatttatcagaagatgtataatgtagaatccaactgcctcattcttcctgaacagccatggccaaacttcttgcattaatggagacagaatgaattgcaaaggttgtataaatcgaggctgttatgtttatgacaattggcagctgtggcataaaaggctcattactatatgtaattgacattttgttgttccttcttcctccactcctttgccaaaaaatggcattggtattactacctctccatgtaggaagtaggatctacctatgagaaagttcaagagagtagttaagcaacttcagctatccctgaccttcttccacaaccctcatgaaactaatccattgcaaaattctgtcttttctacttcctaaatatctttcaaattattcacctgtttccatgtccatccttatttattttatcatcttcgcctacatttttgcaataactcttcaatggttttttgtatttactcctcccccctctaatctcattgcttttagactgatttttaaaaatacaattctaatctttttggtcctccaatctaaactcttattatcttattgcccttagaattcagccccaaatcttcaatcattctttgtctactaagctcaagccataatggtcttccaattctctgacaatgccatttttttttcttcagggtatttgttgttgtttttgttgttgttgttgttgttgtttttgagacggagttttgctctgtcgcccaggctggagtgcagtggtgcaatcttggctcactgcaacctccgcctcccaggttcaagcagttctctgcctctgcctcccaagtagctgggattataggcgcccgccactatgcctggctaatttttgtatttttagtagagatggggtttcaccatgtgggccaggctggtcttgaactcctgacctcgtgatccacccacctgggcctcccaaagtgctgggattacaggcgtaagccacagcgcccagccttctttagggcttttgcagagcagatactttctgcttgg

SEQ ID NO: 13872 - DNA, 1746 bp, Homo sapiens
taatgagattcacatttgattctagaaaaggcagaatgatcatgattaagagaactgaaacccaaaacagatgaaaagacaagaacatgcttttcctgtggcagcagccgggctgagaggagcgtggctgtctcctctctccgccatggcgtgtgctcgcccaatgatatcggtgtactccgaaaagggggagtcatctggcaaaaatgtcacttagcctgctgtattcaaggctcctattcgaccagatattgtgaactttgttcacaccaacttgcgcaaaaacaacagacagccctacgctgccagtgaattagcaggtcatcagaccagtgctgagtcttggggtactggcagagctatggctcgaattcccagagttcgaggtggtgggactcaccgctctggccagggtgcttttggaaacatgtgtcgtggaggccgaaggtttgcaccaaccaaaacctggcgccgttggcatcgtagagtgaacacaacccaaaaacgatatgccatctgttctgccctggctgcctcagccctaccagcactggtcatgtctaaaggtcatcgtattgaggaagttcctgaacttcctttggtatttgaagataaagttgaaggctacaagaagaccaaggaagctgttttgctccttaagaaacttaaagcctggaatgatatcgaaaaggtctatgcctctcagcgaatgagagctggcaaaggcaaaatgagaaaccgtcgccgtatccagcgcaggggcctgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtatggcacttggcgtaaagccgcttccctcaagagtaactacaatcttcccatgcacaagttgattaatacagatcttagcagaatcttgaaaagcccagagatccaaagagccctttgagcaccacgcaagaagattcatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcagcactaccagccaaatcagatgaaaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagaaaagaaacctactacagaggaaaagaagcctgctgcataaactcttaaatttgattattccataaaggtcaaatcattttggacagcttcttttgaataaagacctgattatacaggcagtgaggaaaaaaagaaaagaaaagaaaagaaaagaacatatatcagtgttttgattatttccaagttctaaggtccagatgaattacatgtgaaggcatcaaaactcttgcatttaggattacaaaaacaacctttggtaaataattatcttcaggaactatgagcaagacagttgttcatggaaaagtagaagataaagaaataccctatttttttaaaaaggaagattacagaata

SEQ ID NO: 13873 - DNA, 1283 bp, Homo sapiens
aggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctg

SEQ ID NO: 13874 - DNA, 1281 bp, Homo sapiens
atattatttactagaccattgcatttttataaattcatttacaaggatattttgtcttattttcccaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgttagccttttggaacaaggctgtcacctattttgccaacacgtgaattcaaaacatgaaccggtttgcttttggagaatctgaagactccagt

SEQ ID NO: 13875 - DNA, 2497 bp, Homo sapiens
aagaccagcctggccaacatggtgaaaccctgtctctactaaaaatataaaaaataagccgggtgtgctggcacatacctgtagtcccagctacgctggagactgagggacaagaatcgctcgaacccaggaggcagaggttgcagtgagcagatcgcgccactgcactccagcctgggtgacacagcaagactccatctcaaaaaaaaaaaaaaagtgcttatggtacatatcatgtaattatgaactgttaaaaatggttttataagtatgttccatgatgtaaaaatgtcaacacttagaaaaagcacatggacatcctgctttattacatgattacacctgaaggttgtgctgccatgcacattaatatgtaatgcgggcgttgtttatggggttctttgcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatgaatctacacgcctgccatttgcagtgctccggctgctggtcccagaggtatactggttacagctattgcagccagttccctgagacttgtaaaactcctggtttaggacatggggcctgtggtgtggatggaaaatgctgggcctactggatggtcagccagaggccatgtggtgggtgatgactgaagcgggagcaggttgtaccacacctctcccccccccctcccactccccctccctccctctcccctccccctccctccctcccccctccctccctcccccccctccccctccctccccctccctctctccctaacacccaccctccccctttcccccaccctccccccttctcccctttccccaccctccctccccccttccccctcccccccccccccccgcagcccctgctcctttctctgggctcctggcattgtgccagtgagtgctgggaccaggtaatgagcacagccaaaaaggccagaggttcactaggtcagcatcataccaaacgcctggctttcaccaggcatcagtgtgcttcacttgagagtttggtaccatggttaagatcgagtccatgctaggtaagtcctgttaggaatgtcagtttgtattccgcccacgtgaatgatgctgagcttaatgtatta

SEQ ID NO: 13876 - DNA, 2502 bp, Homo sapiens
ggagtcccatccccttaccctggaccttggggtgggagtggaggggggacctctgccacttacttccaggcagaaaagggcctggagtaacgtgcgggggtgggtagatgatgcttgtctgagcattccacccttcatccccaagccccagagcctcccctgccgtttgtcctcagaactgggttccttttttcccctgtcccttcctctcccttctctcccttgctgcagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaagatcctggtgtcttggtgttttattttactaggcattgcctcatcccaggtgtcagctgagtcctagctctgagggacctgggcagacaggcggtaggtgtgacctggatccacacagctactctgagaaagctggttttgcccaggaaagtctttgggagaagctaaactagatcggtggtcaaagtgtagtccccagaccagcagcatcagctatcatctgggaacttgttagaaatgtagattcttggggtccaccttgaatcagaaatcctgggggtgaggcccagcaaccttttcagcaaggcctctgggtgattgctgtgcgcactgaagtttccgaacctcggagctagagggatggatcgactgcatgtcaagctagaga

SEQ ID NO: 13877 - DNA, 1233 bp, Homo sapiens
gccgctcgcccggcctcggcgccgcgcccgcccggggttccggcgcccggagccccagcccggggccgcgacccgcttccgcccgcctggcgcggggccggagcccgagcagccactgccgagcgcggtgggcgcgaggcgaggggcgcagcggcgcggggcggggagggggcgctcgctcgctccctctcggctgcgcacacgcccgtacaaactctcacacagacacacgcggggtgcgctgccgccgcccgccgctgctcctcctcccgccaccgccttgagagggagagagagggaggcagagagagcgctttgtccgcgcgccgccgcccggcccgggactctgccccgaggaggcagccgcgccgagtccccgcctccgcctctgcccccgggcgggccgggccggccgcggtggggggagccaggctgagggtgggggtgggtggcgggcgggcggagggcggggagggggggcggaggaggaggagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtgagcactcagcgcggccccctccccccgcctcgccccgctcaggccgggacggcgccgggagggaggccgagtccggcgggcggcgcccggcggcggctcccgcgcccgcacgctcacttccacgcaccagaccctcaactctcgccgccggcccgctcctgggacggcccgctcccctccccccacagctctggactctgccctcgccctcggggccgcagccttggggcgccccccgtgccgctccgaaggctcccgaggctcgccggctccttaggggcacccctcgttcgcctggcgccccgggctgctctgagcttccccgccccccaccctttgagcgtcccctgtctcacttctcccctgaccttcctgtcaccccctttgtcagggtccccccttccccaaatccagcgtctcttcctcctcccccggccggaccttctctcttccagtgcctcgtgcccagaacctctcgccct

SEQ ID NO: 13878 - DNA, 1426 bp, Homo sapiens
taatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattag

SEQ ID NO: 13879 - DNA, 2822 bp, Homo sapiens
atgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaacctgcctctttcttgccctcattggtctaattttaaagcaggcaaaagccccctggctttctctccgcccccgccctagccctctcaacaatttagccttaccaatggacagtggcatcgagggtagttagggaactctgttacctggaaatagatgtgcacagctcctcttaaactccagctaaaaatttaatccaaagaggtggaaagtcgagagatcctcttcccagccaatggtgagctgagatcacctcatccccttgagcccaccaagccaccaattcttagtaactctttttttaagtgtagcccatgtttcgctttgggttgtgtgaaaagattacaaagcagtctaggactttcgagtcccagaattatcctcagccccttatgtggatactttgaaaaccagtaagaacttaagaccattcattttctaatttttccccaataagttttgctcttgac

SEQ ID NO: 13880 - DNA, 1099 bp, Homo sapiens
gggaccagagaacacctggcaaacatacattctcccctcacccacccaccctacacaggcatacacggagaattcttttagaaggagggaaaaaggaaaccggaagcagaggctaaaattatccttgagaaaaatcactagaagtgttaaacaagtccctgtgacgcagtgtgtttgtcacttttcagaggtacaaatatcccctcggggctacgagcgatttaactatgttaatgctgttatttcctggcaacaatgggctgcaaactagctttctgctggacctggtaaccatgctaatggcttcatttcagcttaatggttccttctctttttctgtttacagtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagaggtgggtgttgatctgggcttcttccttaattgtctccctcactcctatcctttctcactgggagaggggaagcagtttgtcttatttaccaggttcctaaaaagttatcattacattgaggcagcttgtgaggcaagactaatgataatacgaatatgactgtttatataccaccctgttcccaaggtactccagatggttgatggactacgacatccttataaagtaggtaagggagaggtaactggtattctcccgtctcacagaactagaggaagaatgacttgccaggatagtcttgtccctcactgagggcaggttcctgactcctcattggatgctgcctactattaatagaattgaacttcagttattaccatttcacttacatataagggacaattgctgatttatacaaggtaatattacttatctgattttaacatgttttaacagtaggagatt

SEQ ID NO: 13881 - DNA, 1653 bp, Homo sapiens
aactggaccacactgtaaaagggaagatgaggtagactgtagaaagattagaagcttatgggtgcatgtctaggatgactggttgagaagagggccccactgggggtcctaaatagtaagagaaaggagagcaatgaaggaggtaaaaactgaaaagaggatacagaagaaggaatggaagactgagctgaagagttttctttcccttttgattgcctcttctcattcctcatttcatagagctttgtgggacatgtatgtggtatgtgggcctaaaagacaagggatcatcctggacacacatgtgcatgtgtggggttacctacatgcaattacgttggagattggtagttatttaattcacatccatgtttgtcataaggccttttatgagctttttcttgaaatatgctctttaaacgctaggaaagtaacatttttttgttaatggagtcatttgttcattctttcttcaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatgactcctgtttcttctgtgagctatttgggttgtcctcccatcaagcaagatggatgcacacgcatgcaaaagagtgatatagatccagtccccatgcccaattacacatacggcatctgctagaaaggagcttggaagaaactgaatggttgattggggtccatgaatgaaggttacacaaagatctaattgtccttgaagtatattttctctcatttaatttgggaataataatctgatatggacactttactgtttagaaagcacctttcatgtatataatttcagttgacctcatggttagaaagcctttggtttgtttaggaacaaggactaccactggttctagaaaaggaatttagagttgcaaattatgtttgctcatctcatggcacccaattcagatgctatgtgacgagtacatttgacttttgaatctccctcattttcacatatatagtcacatcacactctacttttcatgtactttggactttttgtctctgctagtgagtatttcaattctgtttaacaactgatgttgcgtattgtgtgtggagctgccttctagccatcagcatagttctagcagcatccctgcctttgggctatacataccttagaaatcaccaggcgtggtggctcacacctataatcccagcactttgggaggccgaggcgggtagatcacgaggtcaggaattcaggatcagcctggcca

SEQ ID NO: 13882 - DNA, 1185 bp, Homo sapiens
agccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgata

SEQ ID NO: 13883 - DNA, 1185 bp, Homo sapiens; identical to SEQ ID NO: 13882

SEQ ID NO: 13884 - DNA, 1153 bp, Homo sapiens
ccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagcccctt

SEQ ID NO: 13885 - DNA, 1199 bp, Homo sapiens
tattacctgttcgtaacttttttaaagttgaaaataattcctcttgatggacatttaacaagagaagcagaagtatgttgctgagaaatgagtagcatcaagtcaggaacagtaggaacaaagggactcctgcctttgctgctgatccaccagaacagccatcagactcctcagaccgctgctggctcctgagctgctcctgagctgcctgtgggatcctgagtggcaatgagccctcgctgtggcactaaagatcctctttcttgtcttgttatttcttcatgttaccttatcctatcctatggtaatattgtctctgtctctctctccctttctccgccatagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaatgtctctgtcatctttaaaaactgtcccttcatttattcggtaaacatcaggatctgtgctgtatgccaaacccctgggtaatgctgaggataaatgctgagccaaatagaccttcagcctgtggtgagagggatagatgctgctcagatcatgcagatgtataaatgggacaaaatgagatcaggactacagaggaaaataagatacagagaaggtagagttcctgggcaagtggggagacccactttatgccttcagtatgtgttcagaactcaatataagttaagacctataggaggcacgagtcaagtaagtgaagattgtcatagggagaacaagtattttaggcagaggaaacagcatgtttgaaggccttgagcagcaatgagcacattatgtccttagggaagtgaaaggagcatagaaaggagctggctagagcgtagaaagcagagggaatgactctaggtga

SEQ ID NO: 13886 - DNA, 1162 bp, Homo sapiens
aaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagcccc

SEQ ID NO: 13887 - DNA, 1156 bp, Homo sapiens
taatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaa

SEQ ID NO: 13888 - DNA, 1316 bp, Homo sapiens
agcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtg

SEQ ID NO: 13889 - DNA, 1186 bp, Homo sapiens
atatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacatttacttgcctatgtgt

SEQ ID NO: 13890 - DNA, 1251 bp, Homo sapiens
tcaaaccagccacatttcgagtgagcaatagactcgtgactcgtggctgctgtattggacagtgctgatccacactccttgtactcagatagagatctgtgaaccagcagcaacatatcacgtgtagcttattagaagaagaatcttagacctagcccctactgactcagaatctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacacggaatcgatagtttttaatgagatgtgatttttctaattaagcaacttcgtgaaagattggtccattaaatctaattatatttttaattttagttcttttcagatataaataattcaggcagtttcacaaggttttactcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctgtaagatgagagttgaggatatatcagataacattcaaaattacatcttcaaatagtcgttttgcgtggagacttgttgcaagtagaaaatcgcactggaatctgtcacataatgaaaatgtctaatatgcagaagttagatttaagaaaaatgtaatggtattgagaaactttcctaatttacattgtatctgtgttccttttgctagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaagtaggtatttcagaggagtacaaatgatgctaccttgaaaggcagacagaatcattagttttgcattatgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctc

SEQ ID NO: 13891 - DNA, 1351 bp, Homo sapiens
acaatcaagaataaagtactattagaaatgtatagaaataaagttattttacttgggcagggagaaaaagctgtttgagtttcaaaggtttttccttaattgtgtttccttttttcttcccctccccaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgttttttgagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacc

SEQ ID NO: 13892 - DNA, 1150 bp, Homo sapiens
tttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccagcagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagattttttatgtcttgcctttgtataagcatcgctttggggaataccaagatgattcattattcagtgattattttcttgaaagataactatgatgattggct

SEQ ID NO: 13893 - DNA, 1885 bp, Homo sapiens
ggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctgtttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgt

SEQ ID NO: 13894 - DNA, 1128 bp, Homo sapiens
aggtgatttcaaatggtgtcttcttcacaaagcctcctctgatttctgcttttattcatttgtttattcattcttttcaaaagacattttattgagtacctaatatgtctgaggctctgggcttggtactgtggataaagtgctgaagaaaacacacagatcattgctcagagcccttagtttactcaggggagagagaaaaagtgtgcatgtaggatgttagatggtagggcagggatggggttataactttaaataggatgttccaagagggaggtcttactggaaaggtgaaatctgagttaggatctgacagcaaaagtgctgtcttcttcccccgctcctcatctggcactgtctgagatctattttgggcagcaaccatgtcgggggtgggggtggtttgacaggagggagagattgagagacagtggaagatgagagagtatgcatgtatctgtgtgtgtactctcttctagtgccgtctagcatttttcctcatggtacttaatacattattttggagtgaatatttttatcaggcttgttttgctgctcttctcattgaggtgaaacacgatttgctctgtgttgtgcagtactgctcagggatggatcaggatccctctgggtccgtgggctttgtgtgacgctgttggagccggccagcatggctttgctgtggaagttgctctgtgagcccagcacacatgaaccccttccaaaggcttagttttctcaaccttaaaatcaggaagttgactaactgattcctaagagctttcctggagccaaggtttttccattttgtatgataaaattctcaccgtgtgcaggaatcctttgtggatggttccagctcacagattgtttcatggtttatgctgatggtttgtacgctgtaaatagagcctatattgcaatacctgtatacctgtaaatagaagtatattgtctttgacactgtcttcttcctgggaggatatcctctccaagtagattgtgagcagttaactgacaggcctggggacataccttgtgtcctttataacctgcaatagactgcacattcagggctggttgattcatagctccatctgtctatctgtccattttttaattgagttc

SEQ ID NO: 13895 - DNA, 1585 bp, Homo sapiens
atgctatacagtcatacacagattcttcttcaattaattttagtatatgcttttaacttatgtttgataaaaaaattatgccaatattgttaggtcggtgatagactatataagtttagtaaaactagcaaaggtaagcggttaggcttcaacattgttgtgatcatgcagtcatcaactttgtttagaaattttgcatttatctcccctgacctcagtttgttaaatgggtttatttttacagaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgt

SEQ ID NO: 13896 - DNA, 1304 bp, Homo sapiens
gaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttcactttgctgccaaggctgtcattttcattaatgctgccaacatgttcatatgaggcttactaagaagttataactaagctttagaactggaagagactttaatttcatctaccatctgattataaactcctgttactcactttgttattcctccag

SEQ ID NO: 13897 - DNA, 1364 bp, Homo sapiens
ctgttttagacgataccattgtatcataagcctctacgtaagtgttaattacggttatttcaaaggacccagagaaagaaatcttttaactctagaaattcagaccaaccactcagaggagggatataggctgtggggaaggttttttgattcagctggctttgtgacagtagctgtatgcaggatttttttaacttttatccaggattaaataagatgagagaaagagaacccctggattaaacaacaacaacaacaaaacccctccaaaccttaaaaaaccaaaaaccgaattctctgataaatccctttatgtattaggatctcgttaattcagaatttagaaaaatatattaatacctgggaaggaggcaggcactcaccataacattatctgtaaagaaagacatagtgggttgattaacacagtaaatcaggtcaggcgggcagaagccttcatacagctaagaaactaaactcttcgtcatctttctagcaagtgaaatatttgaatgttaatgtgaaatccacaagttttttattcataaaaatagatcatggttgggtacatggtgtgtgcctgtagtcccagctatttgggagcctgaggccagaggatcacttgagcctaggagttggaggctgcagtgtgctaggatcatgcctgtggatagccactgcacttcaccctgggcgacaccatgagactctgtctcttttttaaaacaatggatcatgtagaaccttttttgtcaatacttgatgagttcctccaggatgttggtatagatactaaagctagttacccaaatatatttgggtcaagtctcttctcctagcttcagcttttccatctttaaatgagtattttagatttcttagccagtgctgtggtttgaatgtgctccctaaatttcatgtgttggaaacataatccccaaattcttatgttgactagaagtagggcctttgggccgggcttggtggctcaagcctctaattccagcactttgggaggccgaggcaggtggatcacgaggttgggagatcgagaccaacctggctaacatggtgaaaccctgtctctgctaaaaatacaaaaaattagccaggcgtggtagcagatgcctgtagtcccagctactcgggaggctgaggcaggagaagggtgtgaacccgggaggtggagcttgcagtgagccgagattgcaccactgcactccagtctgggcgacagagccagactccatctcaaaaaaaaaaaaaaagaaaaaaagaaaagaaatagggcctttgggaggttgttagggttagataaagttgtcagagtggggcccccatgatgtggctggtggctttataag

SEQ ID NO: 13898 - DNA, 1199 bp, Homo sapiens
aattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacatgtatacatgggctgtgtgtgctctctatggaagtcttgggtaggtggtctcacacctgtggattctgctcttctatgtttgtgcaaggttgaactggacagatccttacagaaagcagattctgggctgagaataggcctttggaaagtgagtgggaggccgggtgcggtggc

SEQ ID NO: 13899 - DNA, 1220 bp, Homo sapiens
atcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaa

SEQ ID NO: 13900 - DNA, 2818 bp, Homo sapiens
cagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggt

SEQ ID NO: 13901 - DNA, 1160 bp, Homo sapiens
aactaacatgtgagagtcccatgaaataatgtaatacagctttgggttagttaacaaaacattgtataatatgtgaggtattcatatttctttttgagaactgtaatacatattatttatttatttattactatcttatagatctaattttttgtagagacaggatcttgtcatgttgcccaggctggtctcgaactcctgggctcaagcaatcctccctcctccgcctcccaaagtgctggaattacaggcgtgagcccccatgcctggcccagattatttttaaacccactggtgcataacaaaaatattaatggtggaacttcttttcaaagcttactgaaaggattagtataatgtgtcatgattaaaaatgtttaaattaggaaatgatttaaaactaggggcagtaaaaacttgtattgggatctttaatataattagcctcatttttttacttgtttgaagaggtctttctaaatctctttgtcttgcttaggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggtaacctgagggacattttaggttggctttcaaagagggaattttgatttcttgttaatgtgcttcgtttgtgttttgtttattcttatggaaaatctgtgggaattagagtttttcctctgtgtgctggattaggatgacctatagaaagtgaatcacaaagttactttctctgtggttgttggacagtctgacctctccagtgttgttacacactgatattagctgtatttttaaatttttttaaaaggttgtagacaggaaattgtataggaagttccacaatgaccctgtaactgcttttaagagaagtcagaacacaagagtacaactgaaggatgtagtcagttctcaggacttgattagaatctcttttgactttgttttgaaaacagagaaactaagtaaccctaaattaggatataccacatattttatcttttagcccaaattttgcaaaagtagtttgggctttatttttact

SEQ ID NO: 13902 - DNA, 1565 bp, Homo sapiens
tagaagccactgaagtgcttggaacttccagagcaggaaaaagacaaaacgtatttttgtattgatttgttcaaagaatggatcctccagaagcggttggttactgccagaaatataaaataattcagatccttgcctcatccttgcgaagcaccccctagtggtttagctcaaagataaatcattgatttttcaggtgtgacaagacctaatattttactaggttatagaaggatctttaaaaaaatgaatgaagtgatttggcttgtgttcatcattctagtcgttattttcaccattcattcccccgggaatgaatgagaacatgttgagtgctaagatcgtgtgctaaatttagttaaatatgtccctggagctaagtaagcgtgtgccactgtcacaccagctgactttcatccatatagtctgcagagtaaacagcatggagtgcttatcagtattcatcaggtcagagttactctggacattagattactggtaatttttattagctttgaagcaacttgttactaatgaagccttttaggaaactgtgggaagattgaacatgaatggtaaagaattggatcctaattccttatttttgctgattctatgcccacttaaacttttggcccttaatatttatttaggaaattcattcatcattcagttattcatttttagagacagggtcacactctgtcacccaggctagagtgccagtggtgtgatcataactcaccaattcactacagtctcaaacttctgggcacaaataatccccctgcctcagtctcttgagtagctggcattacaggtgcacaccatcaggcctggttgtttggttttgtttgtttgttttggagagacagggtcttgctgtgttgcccaagctgatcacaaactcctggcctcaagcaatcctcctgccttagcctcttgaggagctggggttacaggcacaaaccaccacgcctggcaatttttttttatttgtatctatactaagtatatagcttagggtgatggttatcaaactctgggttgtgtctggaagtcaatttagtggtctgcagctagctgttttgttttgtttttattttttccccagcaagatagagaaatatcagaatgttgcatgtaatagggtgtggtttcagtattcttctattgccattttactgtactgaacggtacttgaatgcttgtatcattatatgtacatacacctttgggtcactatgtaaaatgtatttcttattgtgggattatatcaaataaagttttgactaattttgactagcacagtcagacaatctgggttcaagttctacctgtgccatttagattttgactataggcaagttattttatctgctgaagccttagtttcatcatcagtaaaatggaaatacagtaaaattcacctcaaaagattttgaaaattaatgaaatggtgaaagggaactgcctattgtgaggtaagaacgtgttcctttaaacattaactataagtagtattgattctaaagggactacaaccaccctcaagaccatagact

SEQ ID NO: 13903 - DNA, 1800 bp, Homo sapiens
ccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaaggtcattatgtctaaagtcgactgtaagaaaatgtgagagatgtggacagagtcatatactatatgtttatcacattttttatagtagaagaaaattggaa

SEQ ID NO: 13904 - DNA, 1178 bp, Homo sapiens
caccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggcttagttctttcatggtgatttacattttcttgtgaaatacactgtgaacatatctgtcaacagcagttatttttaaggtactattatttttaaggtatttcttcccagccctttcaaatccacattcatcctatttgctgattacttcaatcaagaaatccatttggatcttttaagtatataattctctttgttcacagagctgttatagcccctaattcattggcaaaaagataaaaggttttttttggggggtggggggaggggcttgctctaagttttttccattatgattgacat

SEQ ID NO: 13905 - DNA, 1261 bp, Homo sapiens
ttataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaagtacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtt

SEQ ID NO: 13906 - DNA, 1140 bp, Homo sapiens
gcaggcactcgctgtcacctgtctgtcactgtctcaggtggttcttactgatttgcatctgggatgcaggcactccgtgtcacctgtctgtcactgtctcgggtggttcttactgatttgcatctaggatgcaggcactccgtgtcacctgtctgtcgctgtctggggtggttcttactgatttgcagctgggatgcaggcactccgtgtcacctgtctgtcgctgtctcgggtggttcttactgatttgcatccacataggctttgggctctatcccacctgtcgtcttcggattctctaatacgcaggagtgctcttctgttagtttactcatagtttattaaagtacagagaaaagacatccaggatgataaattttacagtccttgccggggactgccagcttccagtggtgttgcctggcaccagtgtgacccccggtgcctgccccgctgaaccttctgtaaactgtttaactgtgctggtggtttcccattctctaggcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccag

SEQ ID NO: 13907 - DNA, 1201 bp, Homo sapiens
gagtctcactttgtcgcccaggctggagtgcaatggcatgatctaggctcactgcaacctcggcctcctgggttcacgcgatattcctgcctcaggcttccaagtagctgggattacagccgtgcgctaccatgcctggctaatttttgtatttttagtagagacggggtttcaccatgttggccaggctggtctcaaactcctgacctcaaatgatccacccacctcggcctcccaaagtgctgggattacaggcgtgagccaccacgtccagctgagttttggaatttctagccactgcctctttgggctccttctctctaggcatcagtttcccaaattgcctcgagggagaggcctgagaaactgcaggactcctagaggtccccagacagcaggccaggaaggtgcgtgcagcctggctctggaaagccttcaggaaggggactgggggcccagcgtgggctgctgagaaggggcagggtcctccagctcattcctcctgcctcctccgtggcctcaggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgaggggcaggtgctgccagctcacagagtccctgcagacccaggcctcaaagcttctggggctttctggacccaccacagcccctggttttgcttgggcctgcccttgtctgttctaagcctggggtgccctcctttgcacccattcgctcaccatccatctaggaattcttgagggcccacgtgccagggtctgggtgctggaaatcacagggatacatgctgtgggactctccaaggggctttgctgggtggggtgatacggggatagatgctgtgtcctctccaaggggcattgttgggggtcgtgtttcagggatagatcctgtgtcctctccaaggggcattgctggcgggggggtgttatagggataaatgctgtgtcctctccaaagggcg

SEQ ID NO: 13908 - DNA, 1335 bp, Homo sapiens
aggaagagggactgaagttgggggtgtccttctccccacctcctggagttagaccaggaaatggctgtcccttttggcatcatcagggaggtcaagtgctgggagaggccctgggaagggagcctgggatgctgagtccccaaagccctgctccccagctgcccacccctccagccagctgaggctccctgagctggtggccagctggacagggacaagagagcagtgtgcaagaaacaggggctccctaggcatggctcagcagggaggggggtgcctggggagctggagagggcttcctgcagctgtcaggtgtgtctgggggccgtagcgaggggggtgtaagagcagctggcaccctttgaggagggccagagagatcatttgtcagttctagaaacatgagggccccacgggggcttgatggagtgtctctaggccccttaatctgaggccgtggtctgtgtcaggggttatacaggagacatcctacagctttggggtgggggcgtcccagcaggagtctcagggcatatttgtttgttttgagcgggtttgggaacttggccacctggtctgagtaggaggcaccctgggtgtttgggcagcagacagggccaccccaggggagggggtgaggatcctcaccccaccctacccttgctcttggctggactgccccactctggcaggctgccggccgcctatttccgtcgggcaccagggtaacagggccacatcagggtctgagccaggagacacccagccaaggctgggactcgggggtgggggagggtctctgaggagtcatcgcagggcccagcggagcctctggggtccaagcctcccactcaggctgtgtgttagtccccacgtccccacacaggtccatgagggagtccacagccctgcttcatacgtgctgtttgagtcacatagccgccaccctaaagtcccaggagttgtctgcaactgtgagggctggggtagaagccagagacaggagctttgtgtatggggaggcaggggggccagcgcgggtggctgggaggaagagtcccccccattcctgccgccctcttggcagtgattcagaaaggtcctttttcagccagtgtcagagctgctcagctggggagggagggagagagggagagagagaggcaggcaagagggagggcggccgggcgggcagttgggtggggaagccggggagtagggctggactgtgaccactgccctggagagaagacagaaacaggacagaggatcccggctgcagccagcgtgaggaaagctctgctccctgccagaccggccagctgtggaaaccca

SEQ ID NO: 13909 - DNA, 1168 bp, Homo sapiens
cagcaccaggagaagggcggaggcagccccgcagtgcaggagcgcggcgaggcccgggccggggtgcaggagcgcggggaggggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgccccgaagccgccccgagctggtggggagggcccggccggtggggccccgggggcctgcgggggaggggcgcctgggggtgcaagaggcgaattggctgcccggggtgcaggagggacaggtggtgcgggctgtccaggaaacctacctgaacgggaaggagccccaggagggagagggacccggcgaggggctcaggacccggaggcgccggcggaggaggaggtggtgactggcaggcccgggccccacggtacctccggggctgaaggggacgcaggatgtaggggcatggggagtcgggcgcagaagagtgcggggaaccgctgagctctgggagccactgcctgagggcaggccgcggccggcgggaacctcttctgccgtctcagcctgggcgtcgctgaagctgtgtctgcggggaggcagcggaaggcggcaggtaaggaagcccagtcctgttagctggagttggtgtgcttggaagtgagaggctgcaggtccctggcgagagcgtagactccacactgccctcgttcttttggcctttcatccctggagggaggaagcagtgcagttttcagcggcaaggcaggacctctcccccgccagtactgtgtatggtaattggagtgatagggcatcttcttagagtctaggcagcaggcgggacgtctgggtggctgccaggtctgtgcagagggaagagaggggtagccccagggaggagctgcaggacggtcccccctccacctgccccccgatggcagtaggggtgcctccatgctatatgctctgcatggtgcagtcaacacacaagtcctcaaaacacgtcccacagaagggaagagggcagcgtgggattaacagaaccttatcttgtaaccctgttggtcacgtgagctgagatgagtgtgacagctagtggc

SEQ ID NO: 13910 - DNA, 1220 bp, Homo sapiens
gtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaac

SEQ ID NO: 13911 - DNA, 1270 bp, Homo sapiens
tcaaggctgcggggagtcatgattgcattgctgcactctagcctgggtgacagagagaccttgtctcaaggctgtggggagtcgtgattgcatcactgcactctagcctgggtgacagagagacctcgtctcaaggtatgtttcatgtatcttctcttttttcattgataaaggcccaaacttcccagagagaaaaacatacagccttaaggaatttggctagaagtctattcagggcatatgatacgatagaacagggattctgtagaacctggaagaaagtagtcactctaggagtaggttagcttgagagaagtagcaagaatgtacttaaagcagcagataatgagatagaattggggtaaattgcggtaggaatatgttagaagcaagggtggaactgtcgtcactgttacctcgatggcgaagccagaatgtgaggctcttgctcttagaactcacgtgagtaccatagcctcgcgttgtcttgcaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggtgagcactgattccaattacgtttttattttgctgaatgtcaagtattttgaaatgtgatgtgttcctgtgtgttcctgttggaagggtgattgtagccatagtacattttaaagtgaactgaggtataattgtatgtagaattggtaacttgtttgagagaagtcgggaggctgtggattagagacctaggacagagctcagcaggtgtttcagaatccagagcagtgtcaggttttctgtcactcatgtctcccaggcagcccgtcagtaggacacggaatatgaagatctcagcaaggagttgggctgtgtgcctctcgggcgtgacccggatggaaagacagcacagctagcaggattccatctcgtagtgatctgcgcatctaaaagtcaaatattctattaaacgaaactgataagcagggtgaggtggtgcatacccgtagccccagctacttctgctgaggcaggaggattgctggagtccagcccaggcaacatagcaaaatcccatctctaaataaattaataaaactaatattaaagtagctt

SEQ ID NO: 13912 - DNA, 1101 bp, Homo sapiens
cgcctcagcctcccagagtgctgggattacaggcatgagccactttcccgtccactttatgcctttttaagtgccactaggaagacaatcatgagtagattctatacctgtcattgaatttaatctggttggaaagagagacccatgaattatttcaatacgacgtgcaagtgttttctttttatttatgtatttttttgtttgctcccactccaccaggaagcaaatgctacgctagaaaatatccgcaggacactggcggtgcagcagctcagtctcatgtttcaagggggtcttttggaaaaaactacctatgttttgaataggtagctatttgaaataaagctagtatataatttattaagtggtttaaagtatacaaaactgagatgcattatatactttaaaactacttagaatttgatgaaaaccagtattttcaaggcttacctgaaaatattaacagattaacagggatagattacaaatgaaattctgagttcagctctggaactttgtctctttaggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagtgagtgccagctgctgtgcaagtatctagacaagtaattcaagaattatgataggccacggggaaacaataatggtgacactgtggggaatggcttgttagagaagacaagacttgtcatgtttagctaaagaggggaaggggcctgtaaaaaactgaaactatactggtaggggaaaaggtagaacttctctggggagtctcctttttcttaaaaaattaataggcccttgatgttttccccatctttgtagcttattgcttgctgtcattctctggctctgatttttcttcttaacctcttgtaacgttgtactaagctctgctttgctgacaaggacatcagtagcttttctctgttttaggaagcaacacatg

SEQ ID NO: 13913 - DNA, 1738 bp, Homo sapiens
ttaaaacttggatcacccaggcaaggcgtggtggctcacgcctgtcatctcagcactttgggagactgaggctggtggatcacttgaggccacgagtttgagaccagcctgaccaacgtggtgaaaccccatctctactaaaaatacaaaaattagccaggcgtggtggtgggcacctgtaatcccagctacttgggaggctgaggcaggagaatcccttgaacccaggaggcggaggttgcagtgagcagagatggtgccgctgcagtccagcctgggtgacagagcgagactctgtctccaaaacaaaacaaaaaccacacacacatacagaaataaagagaaataatcaactagaaaaaaaacaaaacttggatcacccagaaagagcgtcacagaggcgagggagaatgaagcctcttgttatcctgatcgcctatgacaacgacatttctaactcttctttgaagcgcagttcttactcttaaatctggtcatacaagctttggcttggaatcctgtctgtctttgaaacagctgaagttagtgttttcctgtgttacccagtgttacatagtctcatctttgaacttttctgcgtcagccttctctctttgggaatgctgcctgtttctgtctaacttattctccctggtgtggtgtggcagtgaagtctgtgctgaagcccatctgcttggttcctccaagtgcacattatgcaagtgtatttggatagacagggagatgcccggaacgtggttttcctcctccctccctattggagccatacctcctaaatatattgtctgggtcccaaatgtttgagccctcttcctctgctctcagtgggctgctcttggcatgccctgtgcttggaacgggacctgcaggctgacaggcctctgagactgctagggccagcaaacgtacatgttattgggaaactccctttccccttttggtgagcttctaccacctcagtctaatcgttttgactgaaagctatttgtctgactgaaagctaaaatcttttatagtgtggcctgttagatactttggggtaaatgtggtctgaggtgctggactagcacgggtagatggagaaagctgttgggaagttgcataatgtggtcatctgtgcctaattaaatgaggttagaggtgtgcacaccaccacaatgcctgggatctaaatcttcagatattaacgtttgaggctatggagctgtttccctgaatcacacacgagaaagcagtcaacatgggtgggccaaatgtggccaagatgagagagccagaagtgttggccttagagcagagcctctgtgtgtgagacattagaaggccagagccggggaggtgccggcgcagccactgccttccggtgggccggacggaaagcttggtcttatgctagattcagaagcactgaagaatggaggttgacactttagaggactaggaagggatcatttgtgctcttgcagctattgctgatagctagagccaaagaccattatattgctgaggcttgggtaagaaagttagggatgtgaggaggttgaaaatcctgaagaagagaaaaaatatgagggaggctaaggaaacttagccactttctgatcactgatgactccttaggctgcacctgagtgatggtggtgtttttggaggctgtacctgagtgatggtggtttttggggggctgcacctgagcgatagtgatttttttttggag

SEQ ID NO: 13914 - DNA, 2616 bp, Homo sapiens
tcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctatctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtattagttttttttgtgttgttgtttttacaagataagactctggatattactttcagtaatacaattgagattccaaaagcttgccccctcacgttctcatttaggtcagttactattgattgacaaaggttactttgtagtcccgttgttatgtgtaacgtttgctagccttttttctgctctttgtggtatgtcaaacattcatggtaaacactctgtaaatattagtccagttgttacagaaacattgggtaagctaggcttgttaggtaagtatgattctgtgtttgacata

SEQ ID NO: 13915 - DNA, 1084 bp, Homo sapiens
aataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccag

SEQ ID NO: 13916 - DNA, 2604 bp, Homo sapiens
agacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcagggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaagaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttc

SEQ ID NO: 13917 - DNA, 1207 bp, Homo sapiens
cagaagtggtctgtaagcttcacctaaatgccaaaaggagggtccacggtagagaaaagagttaaaaacccctatgctggcagacctttgtaaggtgaaagaaggtcaggtcctgataccagctattggccatatttggaatctagtctgtgggttttaatctgtaggttttcatgggagtgaaaatgaagtaatagcttaatctaaatttgcccatgaaataaaaatactattaagaataaatatacacctatttgggaggctgaggcaggagaatcacttgaacctgggaggtgaaggttgcagtgagctgagaccgcgccactgcactccagcctgggcgacagagcaagactctgaaaaaaaaagaaaagaaagaaagaaatatataccttattagtaataataatgtatagtgacagtccagctgtagtatcagtgtaattagacttacatcttatgatttgatattttcccctggttcactcagtctttttctgttttctacaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgc

SEQ ID NO: 13918 - DNA, 1512 bp, Homo sapiens
ttgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcc

SEQ ID NO: 13919 - DNA, 2962 bp, Homo sapiens
cctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttatttt

SEQ ID NO: 13920 - DNA, 3035 bp, Homo sapiens
acccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacccctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctatccatgagaaataggaaagaatggtgcagtaaagagactcacatttagtgttctctagcccaggaaacataagatgttcttaatccacccacaatttcccttcccttgcaatcatccagagcatgttttttggaaaactaacctattcttccatcagtagaggttgcttggtgcctatttgatcactttcacaagaaaatctgtgcgctctcttcacacgca

SEQ ID NO: 13921 - DNA, 1352 bp, Homo sapiens
agtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagg

SEQ ID NO: 13922 - DNA, 1501 bp, Homo sapiens
aatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctggatgtccttgttaagtgatttttttgtaagaatatacgtgcagctttctagattgtataggattatcaataatgagattactaattgctgagtat

SEQ ID NO: 13923 - DNA, 1120 bp, Homo sapiens
tctcaattcacctacactacagtacctgacatgctagcttaactgaaaaaagtagtatcaatctgtaatcagctcttttcccccaagatcctaccccaaaaaaaaaaaaaattatccttacatcatcctgtctatgggattgtacccagtttccttttttctacatatgtttatggagaaatcaggaaagttaagaaaataatttgttttaaaataataaagctaatatatgctcagatggtaaaagaacaaaagaaaagatctccaagtcttactttttgatccatttttaagataaaaattttatactatataaataggaaaattaatgaagtgagccttttttcctaagtgaacagtgtgtaaatggtgattcttcctggatgagtaactttttcaaagatactagcttctactatttcatcaataattgtaatggcaaaaatagacaattaatggagatttctgattttgtttctatcattacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatt

SEQ ID NO: 13924 - DNA, 1290 bp, Homo sapiens
ctatttcagaatggtttagaagatttgaaatgttcccaacacaaataaatgataaatgtttgaggtgatggatattctaaataccctgatttgaccattacacattgtatgcacgtaccaaatatcgcatgtaccctataaatacataccattatatatcaataataatatttttaactgtaagtattctttaagattggaaaagtggacagttttgtaagctgaaagtttttttccatatagatttcattcaggaagatcagtagtgcattgaatttcatcaaaaatggcattggtaacacttcaatttttataaaatgatgaggcactcatatctagaacgctatttgcagctctggtttctacacctcctgaaagatatattatgaacatggtaaaggcacctcaagggaataggagaaaaagaactttcatattgtgagcgtcagatcttattagtttggaaagtagatgagaagagaatatggtcacagagtgttgtttagcgcatggcacatggaaaatgctgtagtaatgtttgaaatctgttcatattcatgaatagactctaaggggaacattgggatatgtccatcaaggcctagatgtttaaaaagtagcaaaaacctgtatatatcaaactggagtgagcaaagtcagttagtaggaagtaccatcttatagagatgacagaaaatcctgacaaatgtttgtctgaaaatgtaaatagttttgaaacacactgatggatgatatttataatgattttttaaaaaacctggaatgtttggggatttaattgctactttttgaaggtgctatgagagaaagtaagcatgttccctttcacccatccattcatgcttcatttggaaaacttggctaagtgatcatttgatctcttgtttcatttgctactttagactcttggggcatgatgtttaggactaaaaagggacttagagaatccacttgctcaaaacaaataacttaaaacttaaagtttattgtactataacttgaaaaatttgaaaatcaaaaccattttgtcttaaacagaatttaggttatacttgtgtactaattcttggatatagtaatcttttccaacaaaattgcatgcaacatgcctctttgacttcatgtttgcttttgcaggactaaaaagaggattatttttgctaaaagtagttaagattgctcaattttcacaaagccttgactgttattctcttaaaatgcaaatcttcatctttaaagcagctatccagttttgtctttttttttttt

SEQ ID NO: 13925 - DNA, 2454 bp, Homo sapiens
gggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggttt

SEQ ID NO: 13926 - DNA, 1143 bp, Homo sapiens
cctaatgctgaccctagccctaaacccagtcctaaccctgactctaacccctaaccctgaccctaaacctaaacccaaccctaaccctgactctgacccctaacccgacccctgaccctaacaccgacccttaaccctgccgggagggcgctcagtcccggctcccacaaaggacagcagcacccgtactggacggcacccccggagggacccgggcctgaggactctgctgctccagcgccccagctcacgatcgtccaggacccgtcgggtccctcagcacagcgcggccctgtcgctctcctgaccacgcccctcatggccccgccctatgcctcgcccctggccctcgcgccccgcggctccctccgccgagtccaggcccgacgcgcctgcgccctctgaacacgcccctccccgcccctatccccaccccttaccgcctggccccgcccacgccccttgccgcggggtgggagcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggtcagtgagtccgccccgcctggcctgggccctcggcgcccgctcctcaggctgcggcctcggcccgtgtccggcccggaaggctccgaaccccgggcccgcgctccgtcgtccccgtcggcctggcccgggaagcccttggcaggcccgggagggccggcaccccagcccagtcaggactccgggaggtcgaagaccccagcccaggcaggactccgggagggccaagagcccagcccaggcaggaccccgggagggctgggactccagcctaggcaggacgcagggagggcaagaccccagcccaggcaggactccgggaggtcgaagaccccagcccaggcaggacccagggagggctgggacagcagcccaggcaggacgcagggagggcaagaccccagtccaggcaggacgcagggagggcaagaccccagcccaggcaggactccgggaggt

SEQ ID NO: 13927 - DNA, 1150 bp, Homo sapiens
agaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcc

SEQ ID NO: 13928 - DNA, 1287 bp, Homo sapiens
ccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaa

SEQ ID NO: 13929 - DNA, 1099 bp, Homo sapiens
caacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaag

SEQ ID NO: 13930 - DNA, 1205 bp, Homo sapiens
atatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaggctggtgtttctgcccatgtctacatgcacgtgtgcatgctcgtgtgtgctcacatttgtgcctgtgtgtcaggcctggtctccagaaccagcagcctaaccctcttggagtcccctcgctgggccagagccacaggggctgagaactgcacctcccggcgggagagtttgggtatactgggcttcggtggtgttgggcgtgagcactgcccacatgcctggccaggcctgcgtcctgcacccctgtcccagcggcgccctctctgtgtcctggggctggcacctatggccctcagtgcagggcctggccactccccagcccctcctcaggctttggtgggtggccctacaggaggcagcagactggcctcagagctggggatggggccaggctcaggtcacctctgacctcagggctccgtccgagtgccctcccagccaccctgcggtgctgcgacggtggccgaccccatcttac

SEQ ID NO: 13931 - DNA, 1920 bp, Homo sapiens
cctggtgggaggggcggcgtctccactgactgacctggaggatctgggtagaattggtaaggccaacctcacctgaaaggcccatgagaaccagggcctcttggaaggagcctgggctggggtggccttcagggctcagtggacacaggagtgccatgggcacggggcctgtgggaggagggggctttgggtgaggcgaagacctcatgttcaagtcacctggagacaccagggctcccctccccagccctgagaagtagctgccataggcaggaacatccgtgtaaaggccgggatccttaccctgactgctggtcctcctggagaggccccctcggtgctgccgatgctaggagggcaggtggggcctggccaggccgcctacaggtgggcctcacggatggaccctctcccagcaggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagccagcgtgcccagcatctattctggtgactttctctcatgaggacacgggtgagcctcagtcctggctctggtgacctccacggctcagctcagcctctctgaagtgggcggcctaagagagacccagagacagtgcagtggcaggttgggcagtggtctctgtgtgtaccgggcctgtccctctgcccactgggtctgtgggacgctgtagggtcctggcttggaggcggcctgcccgcagtgccccagtgggagggaagcagtgtgccagccgggccgttgtgtggatgatggtgtgactggctgaggtcctgccccactgcccacccctcccttcttggcatagctcctgcaggccggcctgcaacctgggaagactgtgggccacaggaggaaggaaagcagatgtcagggctgaggaagctccccagaccatgggtcagccagcctacggaaatgggcaaaaaagccaaaaggggtcatgcctcaccttggcccacagctgagcctgtttaccggcgtcc

SEQ ID NO: 13932 - DNA, 1312 bp, Homo sapiens
gttcattgtggggattttccatggaaatccgtgtgtacgttgtagtcgcttgccttaatgcattcccggttttatttttcagtctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctcatttccgtgtgagccgaggctgccgtgcgtttctaacaccgaggttgtgttctgctcctccccggggcccgggcagcatggcgggcatatgcgtagcttctggcaccacggccaccgggagttgagaagccggctggaggccactcctgcccggaccgcagtcctcc

SEQ ID NO: 13933 - DNA, 1141 bp, Homo sapiens
gctggcaccggccttcggccttcagtgggtggtcccactgaagcacggccttctctggccccatgcctgactgtgaatgggtgaggctctgaggaccacagagacctgtccctcaggccctgcccatccctcctgcctggggctctggggctgggtcagtgagagcagatcaggcagtatctggggagtcccagctctgccctcaacttgccctgaggtgacaaagcctcgactgaaggcgagtgggacccactgggtctgcagtagggaaggtccaggcccgaccacacctgggggctgtcccggctctggccttggcccaggccccccccaccaccccgaccaagctggccttcctgcctgcacccatctgggtcttctgtgcccctgagctggggcagtgcccccgccagcatcccaagaacaggaacgggccgcagaggaccagatgtgactgcacaggggcctggacgccagcttcttccctcccgcctgctttctcacctggaaccgtggccatctcagaggaaacccgcctgtctcgggattttctcacccgcagagcggggagggccctctgggctgcctgcagtgcaccgtgtgtccagcagggggcaagcgcccggccccggagccgcagcagggtccgcttggggccgcacagggtcctcgcccgacctgtgtctgaacacgcaggagcggccgggccaggcagtcccagcgcattttaatagtggaatgtaattcctgggcggcagaaaaatgaaagtgagaagtctatgaattattgcaaatgctctcgatctgctgggccgtgcagcggggccctgggctgcaaagcctttttttctcatgtttaagttggcgtggaagatgaaatagtcacagagacgcagtggcccctcaaagctgttattgccagctgtgtgtctcctgtaaacacttttctgatttataacctcactctgctttataaatggaaaaaccagaaacgccttcaggagcagcctttcaccgcccaagaggcctctgcgtccacacgtggccgcgggggcagggtgccgaggcttctggtcagccttccttcccagggccaaggcctccacctaggcctggcgcgaatgtgggtcccggaagggtg

SEQ ID NO: 13934 - DNA, 1175 bp, Homo sapiens
cactccgagggttgacgcagcccctggacctggaggaggcaggagggagctccaagccttcagagggagccatggggcaagtaccaggtaccccctggtgatgctggttggtgccgggtaaattccaggtggcttctgggctccagaccgtgaaagcatgctgctgttttaagctccacccctgcccgtggtattcattccacagccccagagcaagttcccctgggggccgtcctgtgactcccccggccacaccgcacctcacccggagtccccagcccgccccacccagcctcaggtcacgccttcctctgagcagcctccctacactgcaccagctcccgggccccctcctcattccctcctcggccccaccccctgcctctctcctggcctcaccttgccccctcctcttctccggggcgggcggcacccaggccagacacctcctgccagcccatgctgacgccggggctgtgctcagtacgggctcaggatgggctcaggacaggcgaaggcggccgagactcccgggccggcaggccggtgccgcgtcagcagcgggctcattagcggagttaactgtcaggcataaggagggggaaaaagctcaatttgtaaacacttggtcaatatgaggtaaagccaacaggatggatttgggaccacattggacaacgccatcggctgcaccggacgcccagcaacagtaggtaaattaggtcatcattaaattatcatgaggaaaaacgcataatcggcaccagcgctggtagaaagattacggttatttacaaaaaccatgctgtttgcaaatttgtgcaaaattatttgttcctagcagagttttatagagctatctgcacatgatctccgcccgagattcccagccctgcatattaactaatgtctgtggtttaattggaaatagaacaggccacattgtaaatcgcttttctgccatctgtctctgtctccacacggggcctgggagtggaggacacagtgaacagatggatgacagggaccctgcgctgcccggccccaccccactccccgccagagcctcaacttacccctgcaccgcccggccccacccactcccctccagagcctcaacttacccctgcactgcccggccccacctcatccctctccagagcctcaacttaccc

SEQ ID NO: 13935 - DNA, 8120 bp, Homo sapiens
cacacacacgcacacacacacacacagaccaaagctctgtgtagctgtctctccatctgcactgagtctcatgccggggagtggctgtgcaccagcagcagggtgggctgctagggacccctcacattgttggggaccagtggcccttcacgtccgcgagcccccactgctgggtggggccgggggcagcaggtcgtgggcaaacacggagtcgtcccctgaggagctggagctgggggtgtcctggccacccggggagtactgctcgaaaggcgccgacaggtccaggtactcctgctggcgggaggcggggtgagcgctgtgccaccgagcccctcttcgcacagccacctctgtgcccaggctgtgccccagaaggcccgccccacacctcagcactctggggggcaggatggccggggacggcagggggaggggcataggcgggtggcaccaggccagagccagcactcacgtcggtggacgtcacggtaaggacacggtccaggtcctccaccagctgcttgaaggtgggcctctgggagggcgcggcatgccagcactcccgcatgatcatgtacctgcgggcagggcgctcaggagtgagccccgccgcttcccgccttattcgggaacagcctgaagggctgccagtccctcccccgcccagccccggagggacccccacccctgaggacccagtggagggccagggatgccactcacaggtcgtgtgtgcagttggcgggcttgtccatgcggtggccctccttcagcagcttgaagagctcctccacagggatgccggggtacggggagccccccagcgtgaagatctcccagagcaggaccccaaaggaccagctgcaggggaaggtgaggtcaggctgtcctgagactcccaggacagacacctgggcgggcaccaggggaataggccagggctgcgctgctgcccccagggaggggtagaaaccacacccaggagctccagggcacaggcctggggactgcagctggggtcctggctctgcccagttcccgcctccacccctgaagcctgagctctgcaggacacgtacacgtcactctggtgagtgtagactcggtcaaacaaggcctcaggcgccatccacttcacgggcagccggccctgggagggtgtgggaaggcggtgttggcgccaggcgtcctactggcatgacccccacccccgcaccccagggccgggctcacgttggtcgtcttcttgtagtagtcgaggttgtgcacgtcccgggccagcccgaagtctgcgatcttcatcacgttgtcctcggtcaccagcacattgcgggcagccaggtccctgtggatgcactggggaaggggtgggaggcagggctgaagcctctccacctctccccgctgctcccagcatctcagggcagggcccagcctactccacccacacctgccgccctgcccaccttctgggaggccaagtactccatgccccgggccacctggtaggcacaggacaccaggtccttgaaggtgagctgctcctcgggcggcttgcaggtgtcgaaggagtagtccaggcccgggggccgccgcgcccgcagaaactcccgcaggttacccttggccgcgtactccaccagcacgtacaggggccctggggacacgggctcctcagacgggctgccaggcccaggagggccgcccagccggcaccaccgccgctaccgcacctaccgccctgcgtgcaggcgcccagcaggttgatgatgtttttgtgtttcccgatcatcttcatcatctccatctcagacaccaggtccgacaggtccttgtcagtggcatcgtctgtgcacggagcggggggcctgtgtcaggcggcggcggcgcccccagccctgctctgcacccctggccgccccctcctcacctttcagcatcttcacggctacggtgacaggcttggcggcccggtccttgtcaatgccgatggcctccgccatgaccacctggccgaagcagccctccccaaggggcttgcccagggtcagcctggcagtggaggcagagggaccatgagtgtgcaaactcgcccactctcagcccaccacggtccccaccccagcctggcccagcccttgaggcccagagccaccacctccaggaagccctccatgctccccctacagcctgctcgtaaggacgaagagtgtcacccacagcctcccgcccttgctgcccctccagacagggcaccttgagaggggcagtccctgccatacacccgtcccaggagcatctccacagaaccccagccacacccaacatccgccacatccctgacggcccctaaacccagccgggcctctgactggtggctgtttcacccccaccaccaagccccctacagccaacgctggccctcagcaccactgaccgggcccgagacagctcccatttggggtcggcaggcagctcgagctcggagacattggccagcgtggggccctcccctgaggacagccttgcgatgcgcaccagtggtgtgttggagctcatggacgcgttggactccagggacacctgcttgggtcagcaggggcaggttggcgccgcgtgggcgacagggcgtggaggtacagccgggggtcagtgctgggccagaagggggggcgttctgacttccaccagcattgaatgaagatttttagaatgtttcgtgccccaaagtaccctaggctctacatggtgagcagagacgaggagaggggagcccgcctggctgcagagagggctcacacagcccaggaccagcgtgggccgaggtggggctccaggaggcctggcgggcaggcagctcagaacctggtatctactttctgttacctgtcgcttgagcgggaagcgggagatcttgtgcacggtgggggagcccaggcctttcttgggggggctgcgcaggcggcagagcgtcacagccgccaccaccaggatgaacaggaagaagcccaccccgtagctgaggatgcctgcatacacactgcccgcctcgtcagcctccaccagctcctcctcggctgcaaagacatgggcgttgaggcctggcctggcccccccccccacggggctcccatggatgcccctggcccagagccgcaggcaccactgggagcggaagggggctcagaacctcagcacgcgccttgtctggagggtctcgcagtcagtaacgccagtgagtctagagggccagaccctggagagaaggagcccagcagagccagccagtcccacaccgccaccaggcgcccgggagacaccagagccacaggagaggcctttggggacccagatgggaagtgggctcgagggggctgagggggcccctctgggaccaggaccgggccaggccaactttgtccccacactgggcacagggccaggagtgagggctcaagaagcgggacggccgtaagtcacaggattcccgtccgtcctggcagctttggcgtgtcccgagccagcgtcccccagacagtgcggagcagcagcagcagcagaagccggtacctggcagcaccaccagccacgcagagtgatgagaaaacccaatagaattgcccgccaggcaggtgtactccccggcgtcctcaaaggtgacgttgtgcaaggagagaacctctagctccttgtcggtggtgttagcgcccgccgtctacaaagagagagcagagcgataggcgagcgccagcaccgccctgcgggcaccgcacagagtccacacggcaggatccagccgctgcaaggaaaacgccgccaccaccaactcctcagccaccgccaacttggtcaccgccacgcggctgagggccctccgcctggtacaccggtactgagcccgaagccaggcccctccaccggcgagtcctctgtcccaggtgagcggcaggcgggcaggcagcatgcgggttagcgcagagccgggcgggtgcaggtggaggatggacacagggacacacaggctgcggaagcgagcaggcagcgggcaggggtggagagaggcgcaaaggggtgctcacagacggcacggagccggcccggtgggcaccgggcacctcctgtgggggtcgcaggcgtgcgggaagggtcggcgcaggccacagggctcgaagcgggcggtcaccgtggaggctggagctgccagccttgccgaggcggccccgagtggagcgcgagccggggcgggagcgagcagggctgggcgtgcggggcgtgcagggcgcgcggccagggccttggagctggagctcttgtgccggccggcatgggacagagtcgttacctgctcggggcccgtgaacgctcagccaaaaggccttctcggccacgcctatgaaattggtggctcgacagaggtactcgcccccgtcccgctccgacacattggccaggcggaggcgcacgtcggcctccacactctcactgatccaggactgcggggacaagagacccggctcaggcacgcccccgaggcagccccgccgggcacgaggcaggatgtgggagacccccaaggtacagatcgaggctgggctgcgtcagccccaaaggctgcctggaggaggcgtggaggcacttcacggtggctgtggtttcacaggatgcacgtctctgcctccaccccaacaacccagcccagaccctcagacaacctctggtcactggcctgccctcccccgggctcttgcagaacctgcaccctggacagggcccgaggcggcctctctgggcggggtctggactccaccctcgccctgcgcctgctccccgcccccaagagaccgtcttctctctgaacagatgtttctctttgggctttgagtgtcgcaaccgtcccaattcagtggcccccacccggcagccatgggaacaaagctaagggcttcaggaggcgggcagacagtgagctcgggccccactgcacacagctgacgagagccaatcggccaggtcggggctcagccaccgcctctgaggcccagagggggcctggagggcttggccacactgccctcctgtcctggggcaccactgctgcccaagccgcacccacccccaagaagcccgtgggcagctccatgtcagggacttcagtggctgaggctggccctctgcagacacggaaacgggtcccaacgcagctgcctatggccctgaggtgtggggtggctgagacttggccccacaagcacccccacagcttctgcccccgaagctccaacccctagacccaaatcctcacgcaacccgcagccaaggggcacccttggggccagcccaggagccccagcggcggcacccacgtgcacacggtggcccaccttgagcacggtaacgtagggtgtgccgtccgggcccaccttgctgccattcacctccacgtgcttgagccactggatgtggggctgtgcgtcactgtacaccttgcagtggaactccacgtcgctgcccagcaccgccgtctggttggccggcagccccgcctgcaggatgggccggtgcggggagcgctctgtgggggcagatgacgctcaggggccaccccctccctcaccaccaccgccactgccgcccccacccccgcgccgccccagggccctcacccagcacgtccagcgtgtacgtctgccggatgctgccaaacttgttctccacgacgcaggtgtagttgccgcggtccgagggcaccacgctttccatgaccaggctccactgctgatgccgcagctgcaccgggacgcgggcgggtgagtgagcggaggcagcaaccaccgcgcctgccaggcccagagccaccccgccgcgcccaccttgatgcctccaatgcggtgctcgccgcggaactccctgccgttcttcagccaggagatggagggagtggggttgccagcggctgggcagcggaagcggacggtgttggcggccggcacggccagcagcttcttgtccatccgctcgggccgtgtccagtaaggggcccctgcgggccgaggtgcgtgtgaaggccatgacccgagtgggagcagaggcccctctgaacaacccccttcccagagctgcccctgcccatccccagcctcagtttcccgtcctgtgtaggaagagggcgggatgaggttcccaggagcctccacatcttgtcccctccccggggctttctcagagctgggccgtgtgtcccctcccctcccctccagggtgctctgcccggacctgtgaagtcacagggcacagggcattgtccaggggagcccacctgcccagagaggcgtgccagggccaggcccaccaacggggagactgaagacccagggggcaggcccatctagtggacaagccaggacctgggagcagtttaccaggagaggagcccagtcgcctgcagagccaggagccttggaggcagctgggcagcatgggcccacggaaatcaagaccctacaccaccctctgcagagctccaagtctggcgggcacccagagacggtggcaccctggaggccctgcctcctcccatctcgatgtccagggctcccaccacccctctcacagcccaactggtttttctccttcctcagggctggtgctgccttcctgccgggactccaggcaaggatgggctggcattccccaggagggaagcagccctcccctcagtgagctcactgccagccccctccaggcacacgcccatcaggggcactgaggcccagcaagcagcagtgtggacacaggctggaaagaggcaccccacggtgctgagctccctcccaggcctcctggagacccccagggtgagttcccccagctgtttctctcatggactcagcctcccttcctcacctgcttaccccactggcccagggacccagcgcacacaccatcagtccgcaagtcgtaactgccccccatgtctgtgccacgatgaccctcacctgcacgcactcccctcagagctccctccaaaaccagaagccccacctccccaccctacaacttggcaaagtccacctgccaccgttccaggccgggacgccaggcatcgtccccgactgctctctcacagccgcagcccacccaccagccaccctcctgccagccaccctgcccgccactggttgtggcaggtgccccggcgccctcaccccgggtccatccaccccacggcagccacctgagtgccctgccctgctgcgctaatgtctgcggggtccacctcacctatagccaacaccagagccccacaggccagccctggcctcctcctgctcctggaacccccagggccctgtgcctcagtctccccatcagcaacacggtgtccccttgcaccccagccctgccaccagggtggggcatctagagccatgtcagtgacccagcccctcctgtatcctgaggggaccagaccttcggggtgaccccagggaggttgttccggggccttagtccctcagctgcctgtgaagggcagggcttggcggtggcagcgggccccaccccggctggcctgaaccctggaccctgctcctacctgtgtccacacctgtgtcctcagcctcgtcctccccgtcttcgtcatctcccgaggatggagcgtctgcaaggcagagatggccgcaaccaatgcccaacctgccccaggaggcccccaggtgcccctcccagatggggcagggtcccccatttgggcagcacttcctgggggtgccctcctctccaccaatgaccagagagacccccagccgctcctgacccacgcagggactcagggagcccggcactcggctcctttctgtagctggcgtggccccagagctcacctgtcacccgcacactgaagtggcacagtacgcgctgcgtgagccgctgccggcagctgtaggccccggagtcctcgtgggaggcattcagcacctgcagccgctggggccccaccaggacacgctccgagggcaccagccctgtgccatccttgacccagacagtgggccccatgggaccacccccgggcgggggacagctcagctccacagcatccccgctgccgaagacca

SEQ ID NO: 13936 - DNA, 1168 bp, Homo sapiens
caagggacagctgcccagactcagggcccagtaacagtacagaacgaaccaactgaattcacggcttccctccaagctttgaaaggtagcagtccaggctataaaactctagaagcattgcgtaagaagtgttaagtctacaacaaatacatcttgtaaaaactcaataaattatatatatagatatatataaacttgtaacatctaataacatcggaacctgcacacagggccggcccctccctggaaaccgtctccctgcctgggacacacagcaattagaagaatttgtatgaaaataccagcttgctttgaagtccaaaaaataaatctcctaaagaaaaatcctatagaaatctaattctcctgaaaaaggacaaaggaaataaaatatcttcactggaatcacctccaactattaacaaccttttaggcttggaggggatcctccagctccggggcaggctggacgtacattcttggccgtccctctatcggcgggataaaccttctcggttgtcaataagttaaaaattaaaactctccgccatgtggccagctaaatgctggaagtgttggggtgtgggaacaagagtgccaggggcccataaatagctttacaaatatacaggtccagttttaaaacaaaactgcggtgccagaaaaggccctggtcctctgcttgcatgggtgagaccccctggggcctccctccacgcccccccacgccccgcccagggccatgcctgcctcctgtgcccccagggtcgcaggcctccgttgtaccagccttttcctcttccatatatgttatatatatatatgtatatataccatatacacagcatctatttatagaaatgtacactagtttccggaataaaccttttgcataaaaggtaaaggctcccatcttcaggtacccgtaatttcagtctctgaggggcagggtgggaagtgggaaagcctggaggtggggaggcggtgccactaacaccccaggcacaaggtgctggacatgtggggcttccctgcaggctcagctttgggtgtgggaggggccgaggcccaccctgtgatgtcccgtggtgcaaaggcagaggccggagccatgtcgggcccagctccctgccccacgggggtcccaccgggtgggcccacttacatt

SEQ ID NO: 13937 - DNA, 1506 bp, Homo sapiens
gcctcacacatattagctcttttaagtatatgttggtggacaggtggaaatctgtgtttcagggatgattggcaagttaagttatgtgtccatggccacactgtagattattagtggtatgactggagtgtgctgtcttgactgactttcatgttcttcctttaaaaaatgattcctttttctttcagctttatcattttgtgattccgtgtaatttttgtgatactaaaactgccttctgtgacctgaattattataaaaacatcataaattgcttacaaagaaaatcagaccccacaaagctgtagaggtcctggcatacctatcctaggttttaaatgtaattgctttttctttcttttttcttttttttaataccatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaaggtatttaggagacgttgtgtaaggggtcatgtgaccttgagcagtgagcatggccaccctatgagggcacctgcacgagtactggggcgggcggagaaggtgaggacaggcctggtacttccagccacttgcctgagccctggctttgggttggagggtgggctccaggatgccctggcactgcctcctcagttctcagctggctgctgagccagttgagaggtctagagaggtgagctaagtgttcaagattcaaatggctaaaaagaggcaaagcttgtttcttaacgtggttctgccagtttcagagcccttgcttgacaacgtcaggctacactcttttcatggatctcatctccaaggtgttctttagcctgatgtggtcagtggagacaggctgggctctagagtgtgacttcttaagtctgcaccatctgatgagtgggaagcagagctgtgcagaggtgctcccgctgtccttaccctgtggtccagtg

SEQ ID NO: 13938 - DNA, 1227 bp, Homo sapiens
aacacctgctgtgtgctatgcactgtcctgatcctttagctgagagtgagagagaaattttttttttttttttttttgagatggagtctcgccctgtcgcccaggctggagtgcagtggcgtgatctcggctcactgcaagctccgcctcccgggttcacgccattctcctgcctcagcttcctgagtagctgggattacaggcgcctgccaccacgcccggctaattttttgtatttttagtagagacagggtttcattgtgttagccaggatggtcttgatctcctgaactcgtgatccgcccacgttggcctcccaaagtgctgggactacaggcgtgagccaccgcacctggcctgagagacaaaattttgatgaaacgatgttgaggctatcatctaaaacacagcaagggagcacactccatttttgggggtctgtgtgtatttggacattgtagcctggtgaatccttggtcttctggatacacaggtagtgattggatgtgttagtgtttgtcttctgttgttcattttcagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattgtgttctttgggttgtttttccaactttctcttctgcacttaatctttctcatctccaggcttctttcttactctttctaaatagccctgctatggttcatttttgcagctttacctaaagttagtgattgattcaagtgtgatgtgttgccatttctttttatattcaactcaaatatgtacttcatctgattgaattagtgttaagggacacatgacctttgccttgtataacttctgtttttatgatagtttattatttagttacgatgattgcttgtttcaggatgatttgcagcaagagtgttttatgctaagtttaagttgtaaaaatgtccaagtgaattttattaggcctatgggaagaatggaaaacactggaagtgatcatctttgtcttatgaagcttgggtagataaattgatttttacatggagcggctgatgtaacatattaagaatgtacggccgggcacggtggctcacgcctgtaatcccaacactttgggaggccgaggtg

SEQ ID NO: 13939 - DNA, 1107 bp, Homo sapiens
ttaaaaatcagttaaacagactttaaaaaaaaaaaaagacatgagcaattggacatttgaacgctagctgatgatataagagcattgttacttttaagtgtgggagtagcattgtggttatatgtaagactttatgtttagagatttgtgctaaacttcttatggatgaaatgatatgtctgggatttgcttcagaataatctggcagggggacgtggaaccaggtatggatagagccacgctggccccaggttgatgtttttgggggccaagtagcgaggacatggggttcattgtacagtttgtctgcttttgtttatgttcagatttttccatgatagaaagttaagccagaaggacaaaggaattcagaagattcatctttagaacttcacttatttgaggggtaatttttaagcagtaaaaagatcaagggtttatgatttgaaactttacaaaccaaaattattttacagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtccttta

SEQ ID NO: 13940 - DNA, 1139 bp, Homo sapiens
cctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttg

SEQ ID NO: 13941 - DNA, 1173 bp, Homo sapiens
aaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctttgtgttttctgtctttctctccatgcattttttttctcatttttaaagctttttaagtttgttccaccacgttaagggaagagcatgggttg

SEQ ID NO: 13942 - DNA, 1118 bp, Homo sapiens
acatacaggaaattatttgtggtgaaaatgacatttgctctcgtgctgatgtacagatcgctgttttaaaactgatgtttataagttaaggctgtaataagtgtagactgtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacggtacggagatattcagatagagagtgagacagcactctcgtgcattttcttacccctaatttctattttttaaaatttgatctttatagaaaatactggactaagcattcaatctgtttttttaaattaggaaaatgtttgcagtctggtttatttgttgagcatagaataagatacactgataacttttgtaacattggtttgtgattaatttcattaaaattctgtaaacctattattcagaaattatttttaatactaatttacagaaatgttccatggcttgcctttatgtaaaatgcagatctgaaggaagggtcctgttgtctcgaccttgtgcagcaggctcttgggggctcgctttacctttcagtgcatgaggaatcaggggtggtcaagcagacaaggtgcttggcctctgattccccagctggggtgggagg

SEQ ID NO: 13943 - DNA, 1088 bp, Homo sapiens
ctcttgttcatcagcgatgtgcacagacactaagataaaataatgtgagggggcgttgtgttgccctgcctgcctcttgtgctaagaaggcagaggagagctcctctgggatctggggagggctgttctgagtagtgtgtcctagccaggactctgaagctttctaaaaggccacctggaggctgggtaaggagaggcagtggtgggtgtgcaagggtattcggaaggctctcatgtgtggaccaagacagcttactccttccctgcaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaaggtatgtgtcgttatcccctcccctgcttttgagaaattacggttcactgggtaattaggcctaggtttgcttgtggtggttttgtagtcatgtgagaatggtattttttggaaaaaaaattttttttgtttttgttttgagacagggtctcactctgtcatctaggctggagggcagtggcatgattgtagttcactgcagcctcagaatcctgggctcaagccatcctcccaccttagcttcccaagcagctgggactacaggcgtgtttgaccatgccctaataattttatttttttttggagatggggtcttgctgtgttgcccaggctcatttcgaactcctggccccaaaccatcctcctgcctaggcctcccaaagcaatgggattttaggcaagagcctctgtgcctgacctgaaatatttttttgaattgaattattacaattgaatattttaaaatgttacatgaaaggtatctgctataactcacacattcccttaaaacatgccttatgtcagaattctgatggttatttttatgaaa

SEQ ID NO: 13944 - DNA, 1392 bp, Homo sapiens
gtgacagagcttttacagagtcatgccagaaagatgaatacccaagttgaaaatcagtcccttgggagagggcaggtcacatggaaatcagcacagcagcccctgcctgtccacgccgcgctgggggacactcctgcacccggcacagctcctctcagttgccgaaacataaagagacgctaacaggtggtccttaggggcctggcaggtactgtggagtcaacaggccctgccagggagcccgcccgggctgtggtagacagtttgtctgcccgtcctgttcgctggagccagcactattttgtgttcatttgacctgacagttgtaagtcatcttcaaccacgataatgttgaagtcgtgattccatcacttctgtgtgctcacatcttgtgttctgttgcagggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactt

SEQ ID NO: 13945 - DNA, 1175 bp, Homo sapiens
agctcagctgtcacgggtgctgccccaggtcccaggccccaccccctgctgcccaggcacacacccccgcggcaggtgactccaccctgctcctgcgctctgctgtgccgggcacctgcctgctctacgcccctcatccccaggatttcccacccgcaggctttctgcgggagcagtggtggccccggcttctcacccttcaggttttcttgcatctgcgcaccggtggaagagtaggcccagtggactgggtgctgctgggaggtgggaggctgctgggagggcaccggatgccggggccttgcaacctggcagaggctgtgctgctcagggaagcaaggtggccctggggtgaggcggggggctcagaggaaggggagccctcaggaggaagtgttgggggcaactgccagagagcccggccactgcccagtgcccatccggaagctcagcagggagtgggcttggaagtgggcaggggcatggtggcgccggcagcatcctattttgcagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaagggtatgttgtgctgctttaattcatgttgggtggagggaaatggatctttcttgaaaaatttttttctgaaatgaatttgatttttagacctttacgtttttccgtgtgtcctggtccctagaatattaactgtatatgcaccatcctcccccgtaagctgctgcctggcttttgccatctttgaaaacaaactccaaacagcccacaggccccatcctcactgctgcggtgtcagtgggaggctgtgtcacgccactcgccgtctctctctggtcggctccgtgagggtaggggctctgcccattcaggtggtatctgtagatcctaggttctagggcccagagcattccctggcccagagtacatgctcagaaatgcatgttgaaaatatcaacgatttagttgtttaaatgtgaactgaaagtcacttagaaaatattcacaaggctgggctccgtggctcactcctgtaaccccagcactttgggag

SEQ ID NO: 13946 - DNA, 1205 bp, Homo sapiens
agcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgttttgctgttggaaacctggagggaaaccctgattggatgtcatttcctgccatggagcacgcctcccagccctggcctgcagtgtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcaga

SEQ ID NO: 13947 - DNA, 1213 bp, Homo sapiens
cagaatatcagcaccaagttagtttctatagctgacaaaacatttgaatgatataggaaatccaataattacgtagaagtgctaaaatcaactggccaactaggacctattgaagtaattttaacttaagaaaaactagtaacatatacttggattcagtgaatagtgtcctattaataatgattctgattaaaagaagtataataagatctctattttggtagccgttactatatatatggtagtaatagcagtaaaatttagtaattcatacccttgacttagtccacatttttcccttttaaactgtaatttttgtttatatgaatattaaattagttttcattcattgagcttattatctggtcacctaaagtggaaagtgaaaataatcttaagatgatttcaaatttaggcatacagtttgaaatgtaattgcttttctttgtataggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggtacgtatgcttcattgtttctttagtaaatatttccttttgtttttgcgaaatactagagagagtttgagctaaaattttggaagtttttaacaattctttgcatttcacttttggcctttctattttttttccattttcatatgccttttttttttcatttttagtttttttgctgccttttccatttatgttagatctgaaaatagctactttatagcttaagtggatgagttggaggaatgaatgggtttattcccctttaggcatcattatttatataccttattttagatttggggcaggaagtttgaatacag

SEQ ID NO: 13948 - DNA, 1137 bp, Homo sapiens
tgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctgg

SEQ ID NO: 13949 - DNA, 1137 bp, Homo sapiens; identical to SEQ ID NO: 13948

SEQ ID NO: 13950 - DNA, 1787 bp, Homo sapiens
agcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgcc

SEQ ID NO: 13951 - DNA, 1195 bp, Homo sapiens
gcagacacacttaagccagaattgccatcttgaatctgagccctggtgtgcagatgcctctagaatagtagtttcagacttcgttggtggtaaccagttctggtaaacagtctgaaaattgaggctgacagtttctagcatgtggtggaaaagtaatacagaagtcaaggtgaaggggttaattttgacaattttctaactcgtactaagataagattttctttatggcactatttaaagtattacgagtttctagaacattaggtttagttttattcaatacatttcctattttatgtttctgtatataaacatacacatgcattttagttttagaactatacatatattttaatattcttggctttgtagatgaggttttgaaaatagaattttttttttctattccagactccttttagttttggcatgaatcataggacaccaccctaccctgctggggattattgtcttctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatggcggccttgaccagccagtggtgagtggctgccagcacaggcagcgcagggcgttggctccccccgcccaggttatggggtaactggcagtgaaagaaatggatttgcttttgcttcagggggcactccctcctgcaccaccttctagtctgtgtctcctggtacgttcctcctggtcttccctggccacactgcagtaggtggcaggacacctgccctccttgtctgggcacaattcagtcatcaagctatgtgaccctgaagggtgatttttggctttgagcttagtatttctttggtggtacagtttcttgaaaagggagtacaattttcatgtgtttagttctcaacaattcgacatgcaggtaattctttacgcgatgctcttaagcctcaccttcccttttacttatttgtgctgcttcagcctcttcgaggccacagcaggcttggctgggaagaccgcacccttactcttatctttgacctgatggagttttggtgggcccttgttccgggcaggctttcacatgtactgtttgggttctggaaggagtt

SEQ ID NO: 13952 - DNA, 1197 bp, Homo sapiens
acagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagtacagcaggagacctcggctgcttctttctgctgggggagtggggggatagcgggagagggcgtgtaggtgatgtgtccgccatggggagccagggcaccaccccggagcaggtcccaggtctctccaggcaacggctcaccca

SEQ ID NO: 13953 - DNA, 1208 bp, Homo sapiens
cggaggcagggtgttctggtctgattttgagtcactgtgtcatttccctctggggatttgaaaggagccacacacagtgttgagcctgaggcgggggtggggccagtggcagggtaggccctcatcacagtctctaaataagtgtcacttctcagccctgaactcagctgagtcacccggggcttcccggtgtaggctgtgttaggacgtgcacttcctttgtcatttgaggggaattctcaaaaattatgtcactgagatacagtcagaattgtagggtacacacgagtttcaggagacttttcattcagctctgtagttgttagtgggggttggtttgggttgtggcttcggtgactcctgaccctgcgtggggcagaggttagattcctgtgtccagaatcacctggttgaacccgattgtctgcagacaggacagtgtcatgggctccaaaggaggtaagcagggtgcatggccaggcccaccctgggcagctgggggccccctcactggagatcctctggtttacaatgggattcagcttcctgccttccctgctgtctgtgataatggcaaatctctggcaatgagaagactttatcatgtctggtgtgccaatccctgcagacattatggctttagaatatttacattccaaatatttaaaagacaaacagctcaaactggtaggtgggacgggataaggacagtgtgaaaggtggtgtggcctgaagacctcccatccgggctctggcctgggccaggtggggtgggcctgggcagggagaaggtggtcccttgtccctgctttgcttctctaccaaatgaatgatcactacccgctgcactgggggacgcagtgataatctgtggcctcagcctctgggtctagctttctcccctcttgctgtatgtgacagagtgtcttctctctgtcccttcctcatgcagtcggaacacacagatgggcacacctctgtccagagtgttattgagaagttgcaggaagaaaatcgactgttaaaacagaaggtgactcacgtgagtgtctttcacatttcgtttgagaagaacacatggcttacaaactgtaagtgagggttctttccttggctgatgcccagagtcgccccccgccctctggccactaggacttgatacacacagtccctagagactggacttttttgcttaaaacgacgtacgg

SEQ ID NO: 13954 - DNA, 1235 bp, Homo sapiens
ataaaagacagcaatcgcacttgctgtaagaacaccaacactgatgcttttagaacaaaaggtttatcatcaagtggtggcaccattcttaccagattatcgagcatccgcatgagggcttcaaattcctgctcaccaatctgccacttgggaggcgatccagtgccttcccctaccggagaccctggggaacgggacttggctttgtacttctcaggattcagcaggactaagttgtctggtcctcctgcactggccagagttcgaaccttttccaaaacacacacagcatggcttgagttccttactgagatcaagagggtcagatgacttgaataaaaatgtaggtttcaaaagaaaccaaatctctagagtgtaagaataaaaaatgtagaatggatagtgacagactgatcacaaagttactttcagaagtatttctttagcatgacaaaaatattgggcaccaaagttggcagagaaatgagaaaacacagcacctttcaggatcctacaaaggacttgggacttcactacgccacagacataagtcaagaagcagaggggagaacgtgaactaacggctgacggagcggaggggaactcacagctgtaagctgcaggcaagtctctgagtctctacttctgtatacctgctttttcaaagagtactgtgggggtcacgtgacatcacatatgcgatgacacacactaagcacctgatgccaggcctatacacaccagtactccataaatggtagtgactgacatatttgaaaatttaaaaattagaaatgaaaagcccagtaatcctttgccaacttcaatcagtgaaacagcatttgtcctgatcaagtcccaaatccatgagcttatctttggcaaagagattgctcaaagactcctctcctactcgataagtatcaaaaaaaaatctatgtgaaccccagacacatctaaataaactgcagagtgactggaatggctgtcccctacctggatctcacaggcaaccacaaggttatggatgtaatagaaggcctcctcaacgctctctccaactgacacgagcccatggttccggagaataagaacctgaggggaagcatgaatgctctgtggagctgggcaggaagactggtcctttgctttattcttctttctgctgtaatttaaataccagattagatgcctactgaccttgcttttaggccccagatttttctgaatcaaaa

SEQ ID NO: 13955 - DNA, 1240 bp, Homo sapiens
ctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggag

SEQ ID NO: 13956 - DNA, 1218 bp, Homo sapiens
atgcagtttggctttagtgatgttaacacatgattcaaacgtgaaattgattgagtattggtgaaatacagaggagatttaaagccagaagacctgggtttaaatgctggctgtatgacttcatatctgtgtgatcttgggcatgtcatggttggcacttcaatttcttctctctataatgggggaagtgaggccagtcatggtggctcatacctataatcccagtgctttgggaggccaagatgggaagatcgcttgaggccaggagtttgagcaattgggcaacatcgtgaggccccgtctctacaaaatattttgaaaaaattagccaggcccagtggtgcgtgcctgtggtccgcgccactcaggaggctgagacgggaggatcctttcagcctaggagtttaaggctaaagtgagccatgattgtgctatcgtactccagcctgggcagcagagcaagatcctgactctaaaaaaaagtaaaataaagtaaaatgggggaaatgaactgctttagtaacatcatctgttttttctgtgagcagcgtagcttgacagccattggtgaactcgtgccctgtgcttccctgtccagatccccattctgcccgcaacatggagtataacggtttattcatagtagtcgagaaacactcactgaatgaatgaatgaggtgtagaactaagtggagtgggtaattcaacacatattaatttccttcttttttttatttttagaaagaaagaactttcagctaccaagaaagaccgtgtgaatcattgtctgacaatatgtgaaaacatagtggcacagtctgtcaggtaattgcactttgaactgtctagagaaaataagaactttgtatattttcagtcttaatgggctagaatattctttgtgtcccagctattttaaatggattcagaaatccatttaagatgaagaaggacccttttcccatatttctggctatatacaaggatatccagacactgaaatgaataatgttccctttttgtaatcttttatgcaaaaattaaaaccattatggtaattgaacaacatgtttatgtttagttaacacccttagcaactatagttattttaaaaccatctatggtttgatatttttgcatttgttgcaatagtaggaacagcacaagacagttcagtttgtctctcttatttgctttttcttggcagtttgctgtcct

SEQ ID NO: 13957 - DNA, 1194 bp, Homo sapiens
ctcctttggattgtcctagaggcccatgagaaagtattccctaatttcttaggagaacagtttgtgggtagtatgcggtcatgtccagttaaattgcagatatttccgatcgaagatgttccagtcctgagaacttcgtgacattagcaggacttctacaagccatctcttagggtggggcatttactgcagttggctagtactcttttctccttaactttgtcatttgttgatttttttttaactgtccccaaatactgtgggcagagtgtatctagaattgaggcctccaccattgcggagaggacatggatgctgagcagtcccctgagtgaaggttataaagaagcaaatagactacacatgtctgtaaactgctcttgagtgtcccaaatttggggtacttcagttcagctgtaggaaaagcctcaaactgtttatactttgcaagaattggaaacttctaattcacgttaagttttatgtaatacatgataagcttcataggagcttcatcttttatctacttggacttttgcttccgtaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggtaaggtggaggcatatgagtggaagagtctccagcatgtactcaagatagacctttgaaataaataaaaccagatgatccctcagcttctagaccaggctatttggcactggttgattgaatgtgaactgcactggggctgctgtgagcccgcatgggtctctgtgaccctgcagatgcagccgtgcccagggactgggcagtgggtgtgggctggtgtgagccctgtctgccacccagggcctggccctctgtctgtgtcggccatgactatggtgagtcttgtaggcttgagactgtgcctcgggttcctgcgggttctctgtaggtcagttgacagtttctcctgttgtttgggtaactgtggaaacgaacactggcaagtgctgaagcgagcatgtggacgtgcgatatgaaataacgacctggctttcaaaggcagtgaggctctctggaaaggaccttgctgagctagggatgtgggtgtgtagccattcccagtggg

SEQ ID NO: 13958 - DNA, 1117 bp, Homo sapiens
cgtggccttactcacagcctccacattagagagaatctgactgaagtcttactgctgcctcgtgtgaacataaatgtttgccagaaccatgagcaggaaatgttaatctgccttgtttcctgtcctttacacggaagaatttttttctgtatggaatgcgtgccttacaaataatgagtggaaatacccatcgctaatgaaaagttatacttgactgttagtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcgatgttaagtgtttcctgtggaaaaacgttcacattttctctagttttaaagttgaatcaagctgtttgaagattttcacatttcttctagattttatcagcttgttactttatctgtcactttctgtgatttgcagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaacatcttagctttatgggccatatggtctcttttgcaacattcagctctgccctgtgacaggaatgcagttgtaaagacatgagctactggccagctatgttccagtagaactttacttacagaaacagacaggctgtagtttgccaatacctgccttagggaatgtgttgttatattttgtgagttaccttctcagtaaattttatttagtattagtcaggaatattattaagtagcttcttttccagcctggtcaaca

SEQ ID NO: 13959 - DNA, 1160 bp, Homo sapiens
cgggagataaactattattactttttgaccctagacttagtcttcagtccagatgagggagattaaaagattataaatatcttgtgccagatgaggtgattttattttgaaatgaccatgaattcctatcagttgtcttactgggatatttgatagtggaatttgtgcatttgagtcttagatgatctgttttacatttattaagaaagcctttattagcttttatactgtgtattgcctgttgcagtgtttgagtataaatgaaatttctggaaaatattaatggagtacaaactgtgatacttaaaagtaaactagggcctgcatttgtatcatgacctgtttgagtattgatgagaagatagctgtgaagaaaaaggtttaaacaagtgtattttcctttaagaagccactaatagtgcatctccttagagtgtatatttctagaatcctagtgtgcagagtttagactaagactaaaaaaaaaaaaaaacaaattatactgtaatttcatttttatttgtattttagacaccaaaggctctattccctgctggacaggtttcgtctctccaccatgcaagactcacttagtccctctcctccagtctcttcccacccgctggacggggatgggcacgtgtcactggaaacagtgagtccggacaaagtaagtgtccagcgtgtctgcatgggaggcacagggcgctgagtgcctctgtcacctgtggcagatacagagagtgcagaggaggtgccgtggacccaaggagttctggcgctcggctcggctcagtgaagctgtggttagagacgtggggggccatcaaggtctgagggagccaagcagtgctgatgtgggacccttttggtaggagtgtggggtgagtagttagtgggtgaatcaaggaatagtcggccgtggcctgcaggcccctgactgcacaggccttcaagcacatgtcaatgccgttagcctccctccatctcctcataccttctggccacctgtgagttgcactgccactgccagccattctggtatgttgtcagcacctccactgctcatacctcatggttagggaccacctggagccttggtagagccttggtagagccttggtactctactttcctggacaaagttcagcttatgaata

SEQ ID NO: 13960 - DNA, 1056 bp, Homo sapiens
catatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggc

SEQ ID NO: 13961 - DNA, 1161 bp, Homo sapiens
gtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctg

SEQ ID NO: 13962 - DNA, 1210 bp, Homo sapiens
tgacagagcgagaccctttcagtaagtaaataaataacaccatgggcctatcacagagaccctgagctttccacttcagcatgaactgctcctggctggtggctcttagcgttctttggtgggattttctagttagtactgagctgcttttgtgatttgagcatttctggatgggtgtggaattggaaagtcagatgtgcagggcttgcgccttttccttttggatcgcgcgtctcctgacatgaggctgagctcacagagctggcctcgaggcgcgctgtccccagctgatgagacgtttctgtccacaggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcttgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtc

SEQ ID NO: 13963 - DNA, 1243 bp, Homo sapiens
cctgtggtgccacaagcggctttgggcccggaggaatcctacacatctcagaacacttcctcacctgaccctgtcacccatctccccttctcgtgttctcagccccttctttgactcttgaattttgagtttttacagatgtttgggagctcttactctgacatgaagttataattggtaatggagactcagacaatgttgtagattacagagtgaactatgctttttagtgttaaatgcaatagcttgagatacaatgttttacttggtacataaatgctggttttctttcagatttaaggacatacacttttttttttttttttttttaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataactttcttgtgagttttgttcatgcgaactttggaataacttctggtttttagctattagcactttgaattaactgtagcaataacaagggctaactctgttcttcaaagaccttataaagacagtatttgcactttcaaatgccaatatgtctacattaaatctaagcagcataagcattgtgacagaatgtatctcat

SEQ ID NO: 13964 - DNA, 1269 bp, Homo sapiens
aagctaaggaaaaaggtatggcatatgaacaaacccacgtgtctaacagctggggagaacttatttctaaatgtacaattgtttgtttttttcttttttcacctaaaacactgaaaatctgtgtgtgtgtctcagtgattttcaagctgctccaaagccccacacagcctcagccagggtggtgcctagattttgggcttgtttataagactttgaagagaggctccatttatttaatttttattgtttggaaattattttctagatatttgctctcttttgcctatcccagagcagtggtttcttctcctttatttcactttgtttctcaggatgactcacacatggccaaacccctgcacgtggctgccgcctgggttttccaaggagagcacgccggtgtcgcttgctcctgggtttcttttattttttcctgttgttctatttctgggttaaagacagaacattttaagataattttccaggtcaaatacactcatttgatgtttttctttgtgaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaatttgttgtggcaaaaattactgaactttacaaaatagttttgtgtgaaaaaatttttttcaatgtagtgcagcaacaagtaaaaaagtaattcctcttttgatcagactaaaaagtattcattttaaccacatcatttctacactttgttgttattgttgtttgagaaagggtctctgtcgcccagcctggagtgcagtggcacaatctcagctcactgcaacctccatctcccaggttcaagcaattctgcctcagcctcctgagtagctgggattacaggcatccgccaccacacctggctaatttttatatttttagtagagccagggtttcaccatgttggccaggctagtcccaaactgacctcaagtgatccgcctgcctcggccacccaaagttctgggattacaggcatgagccact

SEQ ID NO: 13965 - DNA, 1148 bp, Homo sapiens
actttaatttctttcagcagtgttttttggttttcagtaaacaagtcttttgcctcttcagttaagtttattcctgattattctttttgatgctgttgcaaatggaattgttttcttaatttctctttctggttgttatataaaatgcaacttgatttttgaatgtggattttgtatcctgcaactttgctggatttgtttattctaacaatttttgtgtggactctttaggacttttgacatataagaccacatcatctgtgaacagagataattttacttcatcctttgcagttaggatgccttttattttgttttcttgcctaactgctctggctaggactccagtactatgttaatagaagttaacctatatatttttaagcatagacataaatacagaatctgggcttaaaacgtgaacgctttagccatggcaaggactttttcaattggctttcatgaaactcatgttggttgtttattaatagtttttcttttttcttccctttttgtagaaaattagtgaattaataaagagacccaatgtcagccccaaagtgagagaacttttagagcaaattagtgcttttgacaacgttcccaggaaaaaggcaaaatttcaggtatgaattgactttcttgaatggagggggccgtgtggcccatcagtgactgagcttgtgtgtacctgtccaagtgggatcaatagttctttttctttttctttcttacagaattggatgaagaacagtttaaaagttcataatgaatccattctggaccaggtgtggaatatcttttctgaagcttccaacagcgtaagtcagatctgattttagatttgcattgtggcaaaaataattagtaataatgaaatgggaatttcttatttttggaagtcaaggcagccttcttttttatttttatttttttgagatggagtcttactctgttgcccaggctgcagtgcagtggtgcgatcgtggctcactgcaacttctgcctctgggttcaagcaattctcgtgtctcagcctcccaagtagctgggactgtaggcacgagccatcatgcccagctaattttttgtattttttttttttagcagagacagagtttcaccatgttaagcaggctggtctcgaa

SEQ ID NO: 13966 - DNA, 1153 bp, Homo sapiens
tggtggttcgtaagcggcagcaagatgctgagagtagatgctgtgtctatggtcttagatgtgaattttacagtacaattgcctagacatgcaaagatctatttacatttttaagtgttaactcttggaaatattattcttagcaaacagaaactacttaattggatgctacattcaaaaagaggagattctttaaattcagcagaaaacactttggggaaaggttgatgaatggtttttcccagtgacaccaatactgagcgagcccgggcacttatttggagatttcacaaaaggaacaaagaggaaggagaccctgtgtgagcgcgcacaccctcctgcacctagcgccagcctggcaggggcaggcagaaagggcgagaacaattcagccctggggaggggccatctgaccaaggagaacgctcccccgcctcggtggggcaagtcgggctgaactgccacacccgggaaggtacaggggcagcctcgcccgcccctaggctcacccccgatccagagcccctggggccacggggcaagggaggagcagggcagctgcggggccagggccctctcggatgaggctcccaggaaaaacgcgaaggaatcttgccccaccgcgttccactgtcaggacgagaatatcatctaaggcagggctcccctcccccgcccagcatcccgcgatccagaatcccgcgcgggtacactgtcctcgccgcgctccctccggcctcccgagcccgcccccacttcgcgtacccagcgcacgcggcgcgtttcttttgttgcgcccgccgtgcgagatttgggggtgcacacccggcaacgtggaggggcgtgggggggcttaccttatccgggggcgggaactgcagctgattgacatcgaggggcgtcatcaggggaatggtgtcgaagccatcctccagcagcggctgcttggtgcccttctctgcgaaattgttccccaacttcaccatcgttccgggagctccgaggctgcagcctgcggcgggagggccggggggagtcaccacaagcaagacccggggcggggcgggggggaagtgggcacccacacccaccggcgtcccggcgtccgcgagctccccggccccgcttcgtctcggggagggctcgtggggac

SEQ ID NO: 13967 - DNA, 1228 bp, Homo sapiens
gggtctccggccatagggagggcagctcacccggcagccccgtgcagctgaacggtatttttgctgggagagtggtgctgggccctctgcctgtgtctgcactgaactccctttccctaatgcttgctctgccacccctccggggactgcctgcggcttctcctcctcgtaaggatcgccatttcccttcatggaggctcagggaggtgacatccttgctgtagtgcagagctgggtcacaaaaccagctcccagacaggcatctcagggctccgtcatctcttcatgtgggtgaccctgaggggagggaagtggggagcccgtgggtccctccagtgctggaggtcttgcagggagagaagcacacatgcatctagtcacgctggtagaaggtggggagccaggcacggggcagaggggggctccaggcccagaagagggagggctcacagggaccgcgagcatggggagggccacctggagaaggggggagggaggaccactaggatggggctggtgatgggaaaacgcaagggtgcgggttccttttgcccagaggcagggtggtcagagggaggcgtgagatgggagcagtgggggtcctgtcccagcctcgttcccacgtaccatctttcccccaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggt

SEQ ID NO: 13968 - DNA, 1286 bp, Homo sapiens
aagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgcagcgctttccttcctttctttaccgaaaagaagtctttcttgtacgtgcgtgagaatcagcagagcctgcactcctgttgaatgaaatgcaagtgcaatttgagttataaaagagcaaggttgatgtttcacagttgatggcttcctgccacagcgagaccctggcttcatctccagctggaggggcccctggggcatctgccgtaactgtggggtggcctgggcatgggctgcctgtgcagagagacctgtgctgaaggtgaccatggagtgtcagcccagccatcttcagatcttactgagcggaaagtgcacggtcataattatctttgaattccagttacccatgaagtggagcctacagggtgattgatggcgtgggggctgctgtccatgcggg

SEQ ID NO: 13969 - DNA, 2823 bp, Homo sapiens
gtctttaccacatcaataggactttttatgcgtccgggttaatttttcactccagtgcgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccctctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacatggcagacttggcgacgacaagggtccaggagaactgagacgcaggatggaagacagagaagaccccccggagctcctcgctctgcttggtggcttcaggagtgtggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagagccacgtagtttggcattttgattcagaaagtggggagcagagacccagccaaatccaaactttttttttggttttgttttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggtccagaatgctgtttgtttttagtgagtccaacctcatggaggtggagcccatcaggaggcaatacagtgggtggggatgcccatgggctttgcactgggaagctgggttcacgtcaagggtttgctccctctagctcctaatgcagctcttaactttccctagctctgaattcatcactgaggaaatggagctaataagacgacctatcttgtaggtttgtggtgggagaggaaggacaagattaacttggatagtgcaaaacacagtgcttggcacatgacactccgtaatgatagttgtcttgttttgtctggcagcaggtgtgcatagcccatcatgatctccacacacactcacactctccatgagaatatgatacagatgaggaaactgattcagagaggttaaagaattagctc

SEQ ID NO: 13970 - DNA, 1120 bp, Homo sapiens
tggggtttcgacgccagggagaggagggaaagggttatcagggaaggttcctggtggcagagctcacagggtccgtgctgagccgaattttgcacggtagcctcagagtcccggagccgagtccagagggcgggatgcaggtattgcgaagaggcacacgctccgagaggaaccaccagagcgtgggctttgggcgaggaggggtctcctctggttgggggagatctggcaggcttgggggagatggggctgaaaggatggacagggagggaaggccagaaagctggagacggggatggagagctaaaccgcaaagagcaggcgccctgccccgctgagggccccgcgcctccagctcctccttcccgagcttcccggggtcggcgtccagccggcaaccaatgggccccgcccccgcccgcagccaatgggccgcgtccccgcccgcgcggccgccccgcccctcgcggacccggaagtgggcctggcaccttcccggcctgccgcagggatggggcagctgtgctggctgccgctgctggcaccgctcctgttgctgcgaccgccaggggtccagtccgccggccccatccgggccttcgtggtgccccacagccacatggacgtgggctgggtctacactgtgcaggtaggtgccgaccacgccccgcgcgcccctgaggctgcagcttccctctccccgcgggatctgagtgtgggtttgcgtcccggggcccgatgccggcgcagaaggaggctcagtgggttcaggaccccacgctgccattgactggttgcgtcgctaacttcgggccagtcacttcctgcctctgaacccccatttccccttctggagggtggtgcagattggagggacccctgcattcccggctggggaggggcttgggggttgacagtggtaacccattttccagggaagcctggagcaggagagggtggggctggcttcagagcaggtggatgtcaggtgcccgctgggaaggggccgggctggtcccctgcggggctgaatattggaggccagctcagcgtcctccgccccccaggacaggggtgaaggtggacctgtggtcacctcctggttctgctcaggaccttg

SEQ ID NO: 13971 - DNA, 1778 bp, Homo sapiens
cggcgtgggataatcagagtggccgggtttgggcgtgatgcgtgttcagtggaagggtcataaatctcagagtcgccaaggaaacagaaacggacaaggtcccgggccgtccagcaagcgggggtggaaatagaggattttcggggaagacgttggacaagtcaacgttgctagagactggagtgagtcaggtggtggccagaagaggtggcgtcctgcacagtggcgttcgtgagggtttgggggtcgttgtgcctgggattaacctctcgatgatgaatttcttcccattgtgctttaggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaaggttattgagaaatgttagtcctttaagaatgaaatctgctgtctcccagatggttctcactgtcaaatggagggtgaacatcttaacggtttctgaggctcttagtctctaatcaaagggaagctttctctctctgctgttgggaaccgggtgaggaagaaacacacttggttcttagtgtgggaagaaaccacatgtaatcctgtggtccaggcctctgccttcagagagccaaagcaccttcagtctttccaattggaacattgttttctaggccttgcactgggaatatagcgattacagttgcagggtgagggatgacatagaggagatgtgataccccaccctccttccagattgaagcctttctgcctcagctgctagaagtgttgctgacaaacacccttcagctggttagccctctgggcagtgccttttcagaggagagctgcgttagcca

SEQ ID NO: 13972 - DNA, 1391 bp, Homo sapiens
tgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcaca

SEQ ID NO: 13973 - DNA, 1176 bp, Homo sapiens
ttctttcttttttttttgaggtgtagtctcgctctgttgcccaggctgaagtgcagtggtgctatctcggctcactgcaacctctgtcacctggattcaagcaattctcctaccttagcctccccagtagctgggactacaggcccctgccatcatgcccagctaatttttgtatttttagtagagacgggatttcaccactttggccgggctggtctcgaactcctgacctcaggtgatccacccgccttggcttcccaaagtgctgggattacaggcgtgagccaccgcgcctggccaactgaatcgtattcttctttgtgtactttcctgtctagatgttagactttgcaagcttactaaagggtggataatgcctgagccttctggagtccgtcaggtgtgaagtgagcgctggagctgatgctcgctctgcttcagggcggttttcctggtgtgttcgcagtgtgacaggaaaatcaccttgcctggaaatggtccatatcagttagtagattgttgtttttctaaattgtgatttctagagctgaaagaagcccagcgaaggaagaagcagctggaagaaagatgcagagtcgaggaaagcattggaaacgctgtgctcacctggaataatgagatcttacctaactgggaaacaatgtaagatgtggctctgggtgtggctgaactgcagagcatgtctttctagaatctgtgggccacagctgtagtcgtcatagccagcagtgacaccctggatgcagcgagttgaagttgcatcatcttccttccctctaccctggctcagcctgcgccatcccttgcttggagactgtgatagccccttcccctcccttccagttcaccttcttctcatctcctgagccagcttctaaagcatgagtcagtgtcccctcccttacctagaatttcagtaacttcctgtgactgtcagtacacagtttgaacccttagcaggcaacacccttagtgaggtggcctgccttcctcggcagcctcaccctcggatgcctctcctccacttggacagagccctctccctagggagccccccataggtgttgctccttttaaacctggggcctcgcatgttccaggccctgtgtctggagtgctcttgtcctgtacttcctcagccagcaaactcctgtg

SEQ ID NO: 13974 - DNA, 1768 bp, Homo sapiens
cctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttacttatgt

SEQ ID NO: 13975 - DNA, 1199 bp, Homo sapiens
ggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttagttgtaaactatactgcatgctgacagagaagcgctcttttagctaagcccagaacttctcttttgacaataaagtactgagcagtggtatcatgagggccacctccacattgtcccctgcagaataaatgcggatgacagaaagcttatgctgtctaccactgaacagtgatggagatggtgctaagtttttacagttgtcttagccccagtggttctcaaggtggggctcctggcccagcagcagcaacttgtttgttagaatgcagacgcgcaggccccacctggcctcctgaatcaaaatggtgtgcggcagggtgcagcgagctgttttcacgaggcctccaggtgactggatgtaagcttgcttgagaactatgggttttagctattctggtgtctccctgattttctacagcgccaggatcctagtttggtgaggttt

SEQ ID NO: 13976 - DNA, 1275 bp, Homo sapiens
gaggcgattgatttgacaagttactaaatagcctccacatcaggtcagcagtgctcagtttggaattgccctgtgcggttggtatggagtgcaaatgatcttctttaacttcatccaggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctact

SEQ ID NO: 13977 - DNA, 1133 bp, Homo sapiens
gtttgctgtggtgtcctcagtacctggggtgggattcagtgtgtggcaggagctaagtccacaatgatggcatgagtgggctgcccaagttcttggaggatgaataagagttttccaggtggagaagagctgcaagtacggcctatgccggggcccgagacagcagagagagtgggtgtttgggggcaggaaggatgggccctggatgggagccccaggctgcagaggcaggtcccaggtgggcgatgggctctgggtgttcgctaaggagtcctgtcctcagccaggggcagcagggagctctgcgggctgtttaagaacagagacaacatgactggcatatgggaagggtgtgtgtgcacactcacatgcttgggcggggtaacgtggatggggtttccaatgggaggtgcttttgaggactcgtgagactcatcttggataactttgattaaccgctgagcacaatttcttacctctagtgcaaatttatcttcaaggactccatcctcattacgataagatagtattaaaaggctgcggcaagtttctccaggctaggagaggtagcatcacaacaataaagaggcgccatctttgctttgctgtcttcaaaaatttcaaagcgtatatttcatatcatctaaaaactctcttggatgcactctaagttgcatcattactttattcacccctgaagaatggcgttgattataagccacactctgattttagagatgttaagttgtggaaaataaatggaggtcttagaatcaatgaaatgtggtaataatggaatgtacagatatgtgctatagcatgccagtttctttttgtaaatgcatccagtcaaatttatgttctgggggcttaagtgaaacaggctaggacctgctgtaaatcactaggcacgtgcccatgcaggcttcctcagaggtgagaccttccggttcattctggagagctggcctgggaagcatcttgcaggggagtggggcaccccaccagcgtgagatggggcttgggaatttccaggggatggacaatttgcgaaggaacaataccatccgcggcattgcagccatcaataatcgcaatcagatctcgcgcttcagggcgtaagctgaactctg

SEQ ID NO: 13978 - DNA, 1225 bp, Homo sapiens
cttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagc

SEQ ID NO: 13979 - DNA, 1284 bp, Homo sapiens
agccctgacccctctgcatgtgaccttacttggtggtagggtcattgcgggatggaactcgtccagatgaggtcatgctggatttgggaagggagaagagggaaggtgatgtgaactcacgcagggaggaggccacgtgacatcggaggcagagattggagtgacgcggctgcaggctgaggctcgggaggattgccggctgccagcagaagcgggaagaggccaggaaggtccttcccagagccccagagcctgcgttgtcctcacaacccctgatctgggacttctggtctccagaaccggggagagtaaatgcctgttgttaagctgccgtctgtggcactgtgtcacagcagccacgggacacccatcgagtcaggaactggggaacaaagatgccaattaccgagtgcccaccacgtgcccgggtaggggctggacactttcagaggcatcatctcatttagtctccctgcagcccagtccgtggtatccccatttacagatgaggaaactgaggctctaagaggttcagtcgctgggcccaggtcccagggctctggagtgttggggcctgttgcaggcccaggactgagtcacccgagggaagacagcggggtaggggccgtgcttcatgatgtgcagcattgctggggagcaggagtggcggtgagggagggtggcagtgagcaggccttccgcattctgttttctgaccgtgaggtgcctggagcatccccacggaggcatccagcactcagagggagctgggggcccagtgctcaggaaaggccagggctgggcgtccttctccagggactggatggtctcagatccctctaaacctaagttttacaatcctgaaaaagcactggtgtcttcctcgctttaagtctcagtgaaaatctctctcacctgtcccatgtgtcagggcctgatctcattacttctcagcttttaagcagcattcagaaatgaagatgtgagtaattataccccatccatgcccccgtgatgggtggcagccacagcgctgggctgtcagggagtgaggggttctgtgcaggggagggggtgagcatgagtgagcaggggggtgattgcagcctcgtgggaccatgtacgctgtttcctttccaaccaggtcgttcctgtgccacttgagccatcccgctagtacaccacaccccacggagggatgtccaggcaccccgaggcctgagctcggccggcacagctgtgctcggggatgcaggctgccgtgcaggggatgcgggctgctgt

SEQ ID NO: 13980 - DNA, 1158 bp, Homo sapiens
tgttccactgaaggcagtgcctctccccctgcttacacagcccagcccagcagcgtctccagcccctcgcctggacctctgtgaccttggacaagtcatcgtccctctgtgcctcagtgtacccatctgtaaaaacagggccactgccatcctcggggtacaaccctgctttcttctgacaccaccgccccaccccgcccactgtttgggtgtgaggcctggctgccattttagggaccctgctgcgcccacctttctcatctggctctcgagatgctcccagctgggtgagcagtacttgggcctcacgctgagggtctctggcgtggagggaggtgccttgccgcctgtggattagcagcttctgtggatgtctgcctggagctcgagctaggagggcagctgggtccctcgcgtctgtgggaaggactggggcggaggagggggctttggattctgggacgctcactggtccttgtgggtgccagggctggctctggggcttctcgccatcagcagcttccaggcctacaacaaacaggtctgctgcggataacgagctgggtggcttcatgtcacttcccttggctgaacatttccaaatgtgagggggccagtctgggtgcctcagaagatgcactggctttggggctgggcacacctgggctccagccccaatcgtcacttgctagttgtgtgtttctccaagcggattgtttaaatgccctttgccttagtttccccacataaaaagtacaggtgatgacagctgcttttgaggggttactgtagactcagagatgctgagtgagagtcaagggcctgggcacggcaggcaccagggaacgggcagaatggcctttgtcacagctgtaaatacccttcacagctcagggacaaacctgacgtcgtgccccgtgggagccgctttggcatcatcagccacaccctaggctgggttcatagcttcccctccccttctctggtcctgctgtctcccctgccagccccatctcagtcctggttacaaggctgcagcccagtgccaggagaagcaccgtctccagagagccacccagctcccggttttctcggcacagcatcctcaggaggcgtggtgtcttgagtcatcggtctcagctcgaagcttcattttag

SEQ ID NO: 13981 - DNA, 1513 bp, Homo sapiens
gccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatggctttagaggtcttaccagtctgcagcctcaggcaggaaatgtttggaacacaggattgtcagatccatcatgtggtggaagggaagccccagagaaggggctggaaccctcggttcctgctcccaaccataccgccagatcaccctctgacctgggtcacatccctgcccttctctgagcctaagtttctttgtcaactgaaaacactggaccagatgatgtctgcatcccatctacttctcaaattcttagcagcctgtatagctttcaggtaaggaatagcatgcatttagatgttaaaaatcaaattcccaaacatccaaattcattgcaaagtgaaaggcactgttctttgaaactgccttttgtacttttgtaacaattgtaaagttgtctaaat

SEQ ID NO: 13982 - DNA, 1713 bp, Homo sapiens
tagggccccttcacctaccaaacgcaaagaccgctcagatgagaagtccaaggatcgctcaaaagataaaggggccaccaaggagtcgagtgagaaggatcgcggccgggacaaaacgcgaaagaggcacagcgcttccagtggtagcagcagtaccaggtctcggtccagctcgacttccagctcaggctccagcaccagcactggctcaagcagtggctccagctcttcctcagcctccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcaccaggaatgtgacaaaggatcacatcatggagatattttccacctatgggaaaattaaaatgattgacatgcccgtggaaaggatgcatccccatctgtccaaaggctatgcgtgcgtagagtttgagaatccagatgaagctgagaaggcgctgaagcacatggatggaggacaaattgatggccaggagatcactgccaccgtcgtgctggccccctggcctaggccaacccccaggagattcagccctcccaggagaatgttgccaccaccgcctatgtggctcaggtctcccccacggatgaggagaaggtcccgctccccgaggcgcaggtcccccgtgcgccggagatcacggtccccgggccgccgccgccacaggagccgctccagctccaactcctcccaataaacaggccactgaagctctcgcccctgtaacttatacgccacccagctcagttttgtcacttttctagccaaagcaagaccagtaggaaagcaaacccttgactctggcaggatttgcaggcagcaggcagcacccctctgccagccgggctccggctgcagaagtgctgttggcttggatgctgtgtgcctgtcaagattccctccggttttctggctagaaagctcacccgtttccggttttaagagtcagttcagtggcagagccaccagggacaagtgaggctcttgggggtggtttgaccctgcttacctgggagcacacttttcccttccccgatgacctgggatggtggccaggccgtgcccttgctgttgctgggcagtgtctttttggaaagggagctgccccaggctttagtgcagctgccaacgctgttaggcctggcctctcgaggcctcttctgacttcaagggtcacagccccccaaagatcctctcacccatggtagttgctgctcatggttctgtctgtccgtgcaccgatgcatacaccacaccccaccgctgtactctgaaattggcgagtgagttgagagccagctctgcggggtcatcacgcagccatggttgtgcctgtccttcatggtggtctttcaggttatcttggcaacatgtacattgcttttattttttttcttttttgcttttattgtacagtcagttctataaaatttctcttttgagttttatacctttgtagcattttagatgacattgtgtttgtactttgttgtgtagagtggaagaattgtgttgaataaacccaagatcggaatgcaaatctaaaaaaaaaaaaattaa

SEQ ID NO: 13983 - DNA, 1222 bp, Homo sapiens
tattatcagggtttaatttttcattattgatttgtcagtttttcattagacttatgataacctcaagttaatgtcataaaaccagggacaactcagtagctgagttgccattctcttcttgaaaaaaaaaaatccactctttgtttgtttgtctggcttattcttttaatatcaactcctgcttcatttatggtgtccatcatcagaagttcagcaaagttcagaaaataaaaatatactttaaggagctctttctaaatgttctgatatcctgataataactctgttttcttttatgacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatt

SEQ ID NO: 13984 - DNA, 1138 bp, Homo sapiens
gtgtgaggttgacagcaaataaccagttagttcaagctcttcgcgaggtagctccttttcatgtataaatgttactgggtttttctcttcttagctgtcaagttcaaaactcttctgttttttaaggaactcccaagttatttgaagcagctgcttttaaacctcaccattgccttgactttgcttaatgcagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgt

SEQ ID NO: 13985 - DNA, 1325 bp, Homo sapiens
cttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcac

SEQ ID NO: 13986 - DNA, 1890 bp, Homo sapiens
aggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgac

SEQ ID NO: 13987 - DNA, 1181 bp, Homo sapiens
taagaattaagtgagatgttacatatgtgacagcactcaacatattaaatccacccaaatgttatgttttaatctaaaaattgattttggtatttctcatattttaacctttgttttctttcagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagt

SEQ ID NO: 13988 - DNA, 1455 bp, Homo sapiens
cagccttacttctgctgactacttttaggataataaacttaagtcttccaatccttacgcctctcaaatcctacccttctgttaggttaggaatactttgacttccttattactctcattgagtttttgtatccctagcatcaagaatagtaccttaacaatagataattcactaaatacttaagtgattatattagatgtcaaatctttcttctggttttcatctacatgcatatagtcaaatgcttttgaaaaatttaacaatattcattaatagtcttgtcttttaattatagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcaggtgagttatcagttccagaatattaagaaatagacgtgttctcatttccaaatggaatataaaaattttgatctaagtcattcttttcagttgatttacttagcaaaaaggattaaccaagatctgccctacttcagagttttggagcagtgtaacttctgttatcagtatgaagtttcatttctgtcagttcaaatccattgtgatgtatggaagaacataaattctaaagtttaataaatacttagtaaatggctacatcacatattttaaggtactttagtggatgaagaaggtacaatttttactctcaagaacatgtaacaagaaaatatgcatattctgttgctgtgtattatttctgtatgttatagttttatactgagggttttggaaaacgtaggctgtccctggaagtcatttagtctgacta

SEQ ID NO: 13989 - DNA, 1110 bp, Homo sapiens
caatgatagactggattaagaaaatgtggcacatatacaccatgtaatactatgcagccataaaaaatgatgagttcatgtcctttgcagggacatggatgaagctggaaaccatcagtcttagcaaactgtcacaaggacagaaaaccaaataccgcatgttctcactcatagttgggaattgaacaaagagaacacttggacacagggtggggaacgtcacacactaggtcctgtggtgggggtaggggactgggggagggatagcattaggagaaatacctgatgtaaatgatgagttgatgggtgcagcaaaccaacatggcacatatatacctatgtaacaaacttgcacgttgtgcacatgtaccgtagaacttaaaagtattaaaaaaaaacagttgcttattgcctagggctcagatgttttctctttgtagagatttttatcgtaaatagcttagtttttcataattgcaggcaatctgatattattttgaaccttttacttgtttattcattgagtaggtgactggtatagtggtcccgcaactgaacttgatactgaacctgatgatgaatgggtgaaaaataggaaagatgaaagtcgtgcttttcatgagtgggatgaagatgctgacattgatgaatctggtaagcttgtttggaattaaaattattacatagtgttttaataattgataattaagtacttataattattaggtattagatttatgtattttgtgttttctaaagaaactggtgtttctaagcctactactttttaaaatttgaaggaataataatgaaattttaaattaattgaagtactttaaagagtgcataggattatttctcgtttttatattaaaatcaaaaatcagaaaatggtaccttttttcttatgaaaataatgtacgtttattatagtgctttgtagtttacaatgtgattttagcaccacttcaagtgatcagttgcacagcatctattgagtcatctatggcttgagggaaataggatgaaactgttgagtcgacttactcgtttgtagatagtcttaatacttgcctaataaggttattgtagaattaagaagtaatatac

SEQ ID NO: 13990 - DNA, 1132 bp, Homo sapiens
tggaaaaggtcatgagatttgtgtgtgtcattaaaaatgccttggagatctcataatctggctgactctatacttgttgatttaaagctgtataacctgttttgttcctttttcaagtgatgctgcttaatgctacaaagtgagtattgttttttctgtgatgcctttgtaagaggaagttaattctgtgttcattattgtagctcccactgatgaagtatgatttgggccatgatagtttaaccctactggttcttcacaagtttaacatccccatgttacctctaatacatgttatttcattttcacatcttgcaagcaggaaggaattgacttcaggcactggattttgtttatagaaatgtaattgtaatttcttattgcatatgctctttagcctttactggtaaagtttttcttttttatttcagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtaggtaaatgggtttttaaaatattttcatgtatttttctagatgaatattcatttacattaatgagcaaggccagagagagaaactctgagaggtcaatcaaaaagtagattttatagttagatgatgttttggtggtatatatttttggaaaactagcagtgatgaaattcatgggtaaattataatgatgtctgtaattaaaaaaaattaggaaaatatatttgtgggaggggatgcaaaaagattgacaaaattgataattattgaagataagtgatagatacatggggattcattatactagttctgcttttgactgtttttcagaattaaaagttaaaaattcaattagtaagctttcaaaactgctttaaataattatgtttaataataattatatgaatatttttaaaatacagaataaattctataaaatttaagggtgatataccattatggctccattttggtgatggctcaaaataattgtgaatctgtttttgcctttgaccta

SEQ ID NO: 13991 - DNA, 1229 bp, Homo sapiens
atgttccattttaggaatactagatactttagaaagcaagtctaggaggtatggtgttagtagcttttcccctttcatctacccgtctgttgtatttaacctaatcaagtttccctctttaaaatttctgcctgcctgtatttagcatacatatagagtaatgaaattttaggtttagaaggggcctggtttaatctcttctctttaaagaaaccgtgatttgtgcacatatcatttttctgtgtcaccaggccctccagaatgcaaaccaacatcttcctggcctagtgcactttttattataccattataacttgttaatttatgaatttcttttatttgtactttaaccaagtgtaagggaagtatgctgtgtgcaaaagtgaatagggatgtatttgaatattttttatttgtgcatatttgcacgtatttattacacttttctttttaaatttttattcagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaaggtaagttgcaaaaatggatattcaactgtcaaaacttgtgccatcttctggtatatcattggcaaaacttgtcactgttttatagtaaatgatgtaatgttgaaaaaaattattttgtcacttgttaaagatggcaaggaagactatttaaaaagaactactgcagtggggagtttgcagtagtggagagagatcagtcccgacggtgaatacagtaaggacaagtagggatttatatccaaggggcaaagtgggaagagtggatggaaaactactgaggaaacatcaaggccaaggggattcttgctagactaactataaaattcttgctgaaggcaagaggatagtaacatattgaaggatcagtagtttgattagatgtagatgcagatcagatactaaggctgagagatttttcactaaaccaattcagcaggatttttgctgaaactggactaagccgaacaagaacagagtataaggtcaggcctaagttgagaagagggcccagaggagcctgactcaggtttggtgagagtcttcatca

SEQ ID NO: 13992 - DNA, 1211 bp, Homo sapiens
aaggtgctttttggttttatttgagatgaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaaggttttaattgctttgtgtgtgttttaatggagccccattttagaattattttttccatctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatcttttttaaaaaggtcactgaatttattttaatatttactattgtatttggtagagtgaatttcccactgtataataagtatttatttgtaattcacaagtgatagagctatcttaatttgaattattgctttggtcttaatggtggcaaaatgtttaattttgtctttggaaaaaataggctcggccttgattatagaccatttaatatttctcagcaaatgaaggtatttgcattttacaagtgttttgaatgtcacacaaaatatttttcacatctgggagtcaagttcaagacagtgctttggttttaaaaaaatctaatgaaggcacaggataggccagacccttattaggttttcctttagaataagtgtaaagaccaagtgtcactgatacgcttgtccagattttct

SEQ ID NO: 13993 - DNA, 1216 bp, Homo sapiens
tgaaccatgctaattctatgatcttgagaaaataacgacctcactcctccgttttctcatctgaaaaatgggaatgaaagtaatgcttttttagggtggttgtgaggattaataaaataatccctagtacctgggtaagcactccaagaatgctattgtaactggtttatattattttccacaactgcctttacacttgctctgggtatggccgttttaagacaactaaagcctgaatgctttccatggggtccactcagacatgcttgctcattcaaactctgcgagtcctgaacgcttacccctctgctggcccaaatcctcaccagccgtctcaaatagcttcagccagctttgcacccttggaattctccaggctagagaaaggcaccagtctcatggagtgatacatcaaaatccgctctcggtagacgtcttcccttcgagatctgctttgagggctgccctaacttggcataagaggacaaaccctcggctttctctcgcgtgcgcggtgtggtggcagcaggcggagcctcgaaatgcagaacaacgccggcgagttcgtggacctgtaagttccgcggaaatgctccgctagcaaccgcatcatcggtgccaaggaccacgcatccatccagatgaacgtggccgaggctgacaaggtcacgggcaggtttaatggccagtttaaaacttatgctatctgcggggcgataggatgggtgagtcagatgattcgattctccgattggccaaggccgacagcatcgtctcaaagaagttttgactagagagaatcacggatgtggaatatttgtcataaataaatagtgaaaacctaaaaaaaaaaaaaaaaaagacaaaccctcttttcatcccacagagtgaggagtcaagaaatgtcaaaacgctggtacacctataaatcccctttaaggcaccttctcaagccctctcttacatagttgaagggggttgacggagttgatagccacaggttctgtattgtaatttctcagtaagtcctaaaaatgtgtccaatgtcactatttataatgtagagaacttgtacattataatcagctttgagcttcagccacaattccaagaaacaagaaacatcttgatgtggtttggctctgtgtccccacccaaatctcatgttaaattgtaactcccagtgttggaggaggggcctcgtaggaggtgactg

SEQ ID NO: 13994 - DNA, 1130 bp, Homo sapiens
cctggtacagggagatcacctttctcatgggaatttgtgtgacctgcttttagggagaaagggaggtcagagagtacctctgcacctgctgtttctcaagcgcctttggctgaaaataactaatgtgccaaagcggtatattttggagtggcatgttctgaatcctttcagggtctatcttggtgacaaatagatttttcttaaacaaaacatctttctgctttatttgaaagtgaagccgtctcctaggagtgagcacagaaacccagggcaatgtccaggacgggcagtgatgggtcttgctttggcaggaatctgaaacacttgggcaggtgcacatgtagctgaccccagcacctgcttctttttttgctttcttctgtccatggggaggacacggtttgggtggaattatttgttccttctggaatttggggactcctgagcctctctaagggatctactctaattctattatatttacgttttttgcttattcccagggccttgttttaggaatctattccaaagaaaaagaagatgatgtgccacagttcacaagtgcaggagagaattttgataaattgttagctggaaagctgagagagactttgaacatgtaagtgttgcttgtgggctctagttcttaaagtgcccccaaatcgaaacagtattttttctttcttttcttttttgaaacagagtcttgctctgttgcccaggctggagtgcagtggcacgatcttgactcacttcaacctctgcctcctgggttcaggtggttctcgtgcctcagacacccaagtatctgggatcacaggcatgcctcaccactcccggctttcatatatatatatatatgtattttttttttttttcagtagagttgggtttcactgttgttggccaggctggtgttgaatccctggcctcaagtgatctgcctgccttggcctcccaaagtgctgggattacaggtgtgagccactgtgccaggccaagaatatttttctatgcctttttgtcagaagagacaatgccgggaagtgctctggccagaagcagaagtgaaagcctgtgtctttggaatgcactttggtactttctgtttcagtatggatgggtctgca

SEQ ID NO: 13995 - DNA, 1098 bp, Homo sapiens
ggtgtcagattactagactaattgaatttttagcatttgaaagaagcattcagataatctcgtcttagaaatatttccataaaagcagtccttgcttttggaaattttgtttaatcagatcttaatgatagaattgcatgtgaccatcttaacattgtataacttagttccattgtaggtacttctaaaggaattagttatgagaaaatttacctgatcatatacaattttaaaatggcagacataaagctttagcgaaatacctcatttgaccaatctcaatgagttgtttgattgattatattctttccatgatggatgcctagaatacagttgacaagaggaagtaagtgtctaagcctactagataatgaatttctttgttgtgtttgggtcctaggcagagtattaacattcagacaccttgttgaggagatgtgcagaactttcctctagctaatcccatgtctcctctgcagcaaggaaattcttgcttgctcttctgagaatttaaatgcaaaatatatttctcctttcttcttctgtggagtggaagtgaacaaatgctaaataatgatgccacagcttttcagtgggaaacgctccctaggtgattttccatatcctgtgggccggtatgggaaatgggacaagtagaaagggacaggccaagcatgttagattttgtggtgggagtggagggggtgtggaggaggagatagtatatgtgtaaataaagtttagaaacggcacattaagatttggaaggggaacacagagctgtagttgagtaatccaggatcccagaaatatcaaattctttttttactactccatcttactagctttgaatgttgctaatacagaattttaaaaaagattttgtagctacaagggctgttattatttattttcttctgactcctcttgtttcctccttcttatatcctacataatattttaataatgattgatgtaattggaatagaaaatttcctattgcaattacataccaaagactttctcttggcttattattgtgctaatttctgttacttcgtaatccttcatgaaactaatgaatgttcttctttctct

SEQ ID NO: 13996 - DNA, 1196 bp, Homo sapiens
atagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgttattgtgtcgatctgttatttttatattttacaatataagcatttagttctattttaatgaaattagtggtttggggtattttaattagagttacacataagtcagttatatatatatattgcatggttaagtgtattgattttggcacataaatcaaagtgatttttgggttgctgtattttataagtctagttttaaatattaccaggttttaaaaggatctctcaggatgttttttgaaaatggaaatgcctaaaaaacttcctacgttgccttacttttgcgttattccttggatcctattaatactattttcaacatggtcgt

SEQ ID NO: 13997 - DNA, 1324 bp, Homo sapiens
tctttacattaatgtatcttgaggggtttgttattaagtttatggtaagtccaacatcagaaaattcacatcttactaaataaaatacttaacacatttctaaaagtgctatttgtaaggattagttatttgtatttttctgagacttgaattcatagatttgccttggttcatcagtatattaatgaataatgcctatcctattaacaactccagtacttcaattaaatgttaatttggaaatttttctgcccacttctaaacaggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaattttggccaaagccctttggtatctttgttctagtctctaagtatagttgtttttcaagtgtggagcttttttattattataattatactgttactacatatttagtatctttctaccaggagtactccttaggaaaagtagctgttaaagcagtatttttaagagcatggcttagcgctttgttaggttaatcaggatgtgatcgatctaaaaggggtaaaatgtgtgtagtgatcatttgaaactggaccccaaaagagagaataatgaaaggagagctctctacttgtctttcttagagttcctttcataaggctcataatttattaactacatttttgtcagatgtttttattatacttctagcttctcaaacacgtttattagtattaggtaagaggaaagcatattttagatctcagtttaacaaaattcttagtgatggaagttttatgcagtatacaaaataatttgtatagtgtgttaaaat

SEQ ID NO: 13998 - DNA, 1162 bp, Homo sapiens
gaagtggattataaaagtattgagcaaaacccaccactgttgactgtaatgatgtgaggtggagttgtctttatctccagtagcagtgtttgtgctaacttctgaatatacttttagtgcacaaaatacctcttcacaaattgaaggagaatttgagaaagattgagatgccatcttcttttactcaatttggacctatcctttcttcatcctaccctcagtatctgatttctgttgtctaagtaggaggggttttacttgcagcagactgagttcttgtgttacctcacctaatgttaaaagttaaggaaggtggggcatcagcaaggaagggaaagatgtttgtggtggagaatgggaaacccttgattgtagggtattttttattatttctgatagttacataatccattggactttttattcatttgaacgttggacatttactctctttgtgattataacgctaccgtgaacattctgcataaaattcagaatctgaattctaaatttttgtttttaggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacaggtgagttattgtataccatggtacatatttcatttatgtttaagtttaccaaatgttgcatatttgattctggtggtcatttcccttgtctgtcctatagaacatcttgaagaatagctgatttgatgtttaattggcactctgaatttcagagtggaaatcctatagagaatacctctcccctgaatctaggggaaaatagt

SEQ ID NO: 13999 - DNA, 1151 bp, Homo sapiens
gatctaaacaggtgatgggtggggtgtgagaagggggtgacccactcaactgcaatcaggttttccttttttataatgttattttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtaataatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaactttgtggcgaggctcctggactgatccctctgtgcggccatgtggctttaaggcctttccttaaagggggcttgtccccatactccatggggtcgggaatgggtctattatcaagactctaaaaataactcttagacatgaagagcactgtgttattggacagtggatgataaggccaccttacatttagcaaagctttatatttttccaatgcacattagtactcacctcatttgttcataaatagctctgaagtttattgcagggcaggtattattctaatttcagagagaaggaaatagacatgaaaactatatgaattgcctgccatggttatccaatagggactggcaaagcaataactttccctctgatcagcagacattgtattttctttctaagacaccctgctatactctcccagagaaagactttcatttctagcatgattttgaatttggcagcaccttgagataaagtaaaaagtgcaataaaatatgcatagccagaagaaaaatcatactgaatagacaccattcaatcaactggtccatttaacaattaacaaacatgcaattgcatgccccactctttttacattcaaggccccactcttgaaagtggtccagaaattttggatagttttctgttgtactaaggaggatatctagctggtctggttgtttctccccctgcatagctat

SEQ ID NO: 14000 - DNA, 1161 bp, Homo sapiens
catggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtga

SEQ ID NO: 14001 - DNA, 1194 bp, Homo sapiens
ataaggtccttttgtgcaaatatttttactgtgatttatagcttgtattgattatgatcatgtggtggccttagctatttagttcttgttctgataaagcttactaagtagttaataataatactagattttaatctcacgaaattgccactgttgttatgtggagatctttttatacaaaatgaaggctgaatttattgattttgttgtaaattgatgggaatataactttcctataaaaccattctttgattcagacttctgatttctaattctttatatatgataagccattaatttaaaaatgcttttatggccttttcttttttagttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcatattctgcttcatcttctcttagtgatatagtcactatgatagactttattttttctgagctttctctttaatgctatgtgcagaactagtgtttaaagaaaacagggccaggcatggtggctcatgctggtaatctcagcactttgggagtctgaggtgggtggctcacctgaagtcaggagttcaagaccagcctggccaacatggcaaaaccccgtctctactaaaaatacaaaaatgagctgggcgtggtgcatgcccctataattccagccacttgggaggctgaggcatgagaatcgcttaaacctgggagccagaggtttcagtgggctgagattgcgccattgcactccatccagcctgcgtgatggagtgagactctgtctcaaaaaagaaagagagaaggtgaacaaattgaatatgaagaaaaagtctaatcttttctgtcagaagggtaggtatcaggaattgttcctgtatcattgaaatagtcgctcatcactggaaattttaat

SEQ ID NO: 14002 - DNA, 1248 bp, Homo sapiens
gggaattagttgacagaaaggaaactagactctgtaaaaggagttaagagctagggagaggcagggtggggtgatggacaggttggtagcatgggaactgaatgggtaatcagaaactgggtccagaatgaagtagcaggtgaatttcagcacagcattctccttgtcctttctctgctaagacacagaaaacattagggttttaggtggatggaccacctgaggtcaggagttcgccagcctggccaacgtggtgaaaccccgtctctactaaaaatacaaaaattatccaggcatggtggtggatgcctgtaatcctagctacttgggaggtggaggcaggagaatcacttgaacctgggaggtggaggttacagtgagctgagatcacaccattgcactccagcctgggcaacaagagcaaaactgcatctcaaaaaaaaaaaagaaagaaagaaaagaaagaaaacagtagggttttacagtttttcacatcataacagctggtgtcaaaatcaaaattagttactaaattacctgaaattttggaaattcgtatttctaataatctgttattccagaaaaaataggaatttactataggagagttatatcacattgtcttatgttgtagaacctgaaacataaccatatgtttttcttgtgaatttgtattgttgttgacttttatttgtgttgatgaacagaaatagaacatatgatacttgggttttgccctgtctgattcccaaaagttaaatcagaacacagtgattgatttctttttgtgaaatgtaacttagagactattgatctgttttccttttttttttttttttgagacagagtgtcactctgttgcccatagtacagtggtacaatcttggctcactgcaacctctgccttctgggttcaagcaattatcctgcctcagcctcctaggtagctgggattataggcgcccaccaccacatctggctaatttttatgtttttagtacagatggggtttcgccctgttggccaggctggtctcgaacttctgacctcaagtgatccctaccctctcatccttccaaactgctgggattacagtcatgagccactgcgtccggcctattgatctgtttttcattactatgaacaactggtcaggctcagtggctcatgcctgtaatcccagcattttgggaggccgaagtgggaggatcacttgaatccaggtgttggagactagcctgggcaaca

SEQ ID NO: 14003 - DNA, 1199 bp, Homo sapiens
ccatggcttcctggccatttaatgccaaggttccggcagcctgctcacaccatctcaaactacactgtaaattgcacagctcagttctgatgtcattttgtttgtttggggtggaggaaagtggaaggacatttaaaaatgaatcctgtttttgttcctgtttctttccatagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttctactttgcagtggtgtctttttgtaaatcatcttttgtaaagcaattaaaattatagtgccgagaagtacaatttgactacattatatttgactaggtatctgtgtgcgattcatctgtttgtactcaggtaaacgttttagaggtaaataacaaatttgttgagacaaatattgaatggtgattctctaccaggtacctcactaggtgctgcaaagatgaaagtgagaagactagttgagtatcccttatccagaaaagcttgggaacagaagtgttttggacttgagatttttttggattttggaatatttgcatataaatgatgagacattttgaggatgggacccaagtctaagcatgaaattta

SEQ ID NO: 14004 - DNA, 1158 bp, Homo sapiens
gtgagcgggaagccgcttggaaaacacccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggtaagtctgagggaatcggagcgccgggaaccgggaaagttgcgggcgtctggcagctcacggcgggcagcgggttcgggggccgcggcgcgcttggcgttcgggggcccgcgggggcggcgtcgcgtgcgccgagcgcggcggcggcggcgtgtggccgtgcgctgccgctctgcgctgccgtggctcaggctccagcgcgtgagggcgggcggcggcggcggcggcgaggccggcgggtgcgggcgtgagtgcggcagggcgcgcggggccctcgggcgccgtgcctcccgcgcgcctccagcgggctctgcctgggggccccgtgcatctttgttcctcgcggccgttgtcgccgcttcgccccgctagtgcccccggccccgggcgctttgtctttcaccgctacccgctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgta

SEQ ID NO: 14005 - DNA, 3159 bp, Homo sapiens
cccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaatggtgaaatgggctttgtcactcaagggtcatatctctcaaatcagaatcatttaaagctgattgcaacaaaatttgagaatattacttagcaataacttacttttccaatataagatggtcattttgtctgctataggaaggaacacataatcgtttgcctttgaggggtgggggtgggtcctagaagtggggatagtattctt

SEQ ID NO: 14006 - DNA, 1566 bp, Homo sapiens
aaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttag

SEQ ID NO: 14007 - DNA, 1151 bp, Homo sapiens
cgaagatggtctcgatctcctgacctcgtgatccacccgcctcggcctcccaaagttctgggattacaggcttgagccactgcgcccggcctagaaccctgcttctcatataagatgggcctgcacctacctctggcatgtttttctttgtgtatttcctgtttttcatcctgtaactaatgctcattatttaaaacactccagttacttttccctttaggcctggcaaacttttctttttcttttttttttttataactgtacattttacaaaacacctgaaaggacccagaggcataaatagtattacatgatttatggtagctctggggtgagctgtgggggaggccagttacaaggtctccaagacccgcctccatgtcagtgttggggggtgccttgagcacttcttttatttcatataggaaaatgcacatctttcatttgtctcccaaaagatgatttccataaaaatatacttcaaagtatttactgtacatagacttcaatgattttatttccagcatcaaactaaacatttctaaccttttaaataaatggggaatttagtttcatgagaatttttactgacaactaataaacactgtatgtgtacatattcatatacactgtggactggagaaagtcagtatggaaataaatttcactgagatccagaaagtagcaatataggacttttaggggtatgtattagtgtaaataatatatgtgcagtctaggctaatcattttaattaaaaacaaataagcatacttttttgctttaaaaatatgccctcaaaatggtgggggataaaatgtaagatattctttagctttaattatttttccatcttattcaagtcagagcacttttttttaaatagcaatacaacaggcaagagaatactcaaaaatatttaaaactgtattgataccaagagtatgttttaaatattttctaataaatacttgagcggtttttgtctggcaggcttccaaatttgccaaaattaagcgttcagtattttcaacacatacgctttttactggtttatactgaactatctgatgagaattcctgtgttcccaaagcaactgatgtttacaggtcttgtgttactcctcctcctttctaaggatgagggaatc

SEQ ID NO: 14008 - DNA, 1097 bp, Homo sapiens
ttataattcttctgtgtttttaaatattcaggcagattaatatgtgatatgatgcttacccttggttaaagatctacattttttgttttctcttgcagcaatgacttgacttgaagagctctaagagactgaaaacttatatgaagttgccttgggaatatttttatatattttatacagtttctatcatggagtcagcaggcacgtggataaaacctaaaagggaatattattgctgtgccatatacagaattcagtttgctttgaaacaagttttggttgaaagagtctgttgaaaattttattatacttccagggaaggaaagagctgtttttatcttcttaaccactcccagcctctactcttcccagcccctaatcccaggccttggtgtacacactgtagtttttccattatgatgagtatgtgcagtgatactattcatgtacagtctgagcttatgctcaggggtgtgtgtgtatatgtgtatgcatgtgtgcacgtgagtgtgtgtttctttttccagttcctgcatcctattttgacactggttgtaagaagatcttgatacatacaggttagctgttacaaaagataaaagatgaatcttcagtggtaaaagctcagtggaaataatctagttagccctgaggagttgattccccaagggaccatggagtcagatgggaccagatgctagactttggattccttgaccacaaattcagcattaactcctgccaccaccatgtcactcctacagcacttacacattttgagaaggtttttttttttttttttttgaggcagagtctcgctgtgtcccctaggctggagtgcagtggcacaatctccactcacctcaatctccacctccccaggttcaagcgattctcctgcctcagcctcccaagtagctgggattacaggcatgcaccaccacgctcgactaatttttgtatttttagtagagacggggtatcactatattggtcaggctggtcttgaactcctgacctcaggcgatctacccgcctcggcctcccaaagtgctgggaatataggcgtgggccactgcacccggttttttgttttt

SEQ ID NO: 14009 - DNA, 1232 bp, Homo sapiens
aagcagttggagggagtaaactgaatccacaaacttctgtctcaggtagaagcattgaaagcattggaatggaggcttagaccatcgttgtgtttgaagaattttctagctctaccaagtagaagatggaatgagaaggcactgaggaaattactcacctttcttattaggaaatacatcctggaattatgagcagccagttaattctaagggtaattgcatactgctggggtgtggctcaaaaatattatgctatttatatattatgtttattaaaagggagcaagttggcatgaacagtataaaatagacattttaagaatatctggttattttcgttaaaaactgtttgttcttgtttcctgctatgttacagcccttcacagtatcacatttgaaactttgtgctggaatcatgataactgcatctcacaatccaaagcaggataatggttataaggtattttcctttttctactccacacgtacatccttctgtaggaatcctgtatctgtaatttttgggaccataggtaataggtgccttatttccattaactgtaaaccttctgaatgtgttcctgggtcctctaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggtaaatgaattgtgtcttcactgaccttaagtgagttaatgtgattcagccaaattctattagtgtttgtgaagtttttctctttaatttgctcatgtactacagctgcatctgattttattttattttatttacttattttgagacagggtctcactgtgtcacccaggctggagtgcagtggcacgatttggctcactacaacctctgccttctgggttcaagcgattcttgtgcctcagcctcccaagtagctggtatcacaggcgtgagccactgcacccagctaatttttttgtatttttagtagagacaaggtgttggcatgttggccaggctagtcttgaactcctggcctcaagtgatccacccaccttggcctcccaaagtgctgagattacaggtatgagccaccacgcccacccagctgcatctgattttaga

SEQ ID NO: 14010 - DNA, 1388 bp, Homo sapiens
aaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcggggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcacatttttatggtggttttttttttttttttaactttggatttttgcttttcagcccaggagtaaaggaatgccttatgaacacctgtggcctacgtgtggtcatgacccaaccatcagtgagattatttgagatattggtgtctgcatccagtgttgttatctgagtgtttattacgtaagttgtaacacctctacacagggtgtgagtttagcactgatgagaccagctccatcattgtatgtggcagtgagtcctgttacgagattgggttgggcagaaaggactgttgacatgagcctgtggatgtaggttggacagtctcagcctgtgactgactaggcaaggagcggagaggcaactgtgtgaggattctcagagccaaatttttaagccatgttttggg

SEQ ID NO: 14011 - DNA, 3005 bp, Homo sapiens
aaagtttaagaaaatcccacaaactttcaatttggagttctcattatctcattaaatgaatagcactgcatataattaagctcccaagcaggtttaagatttgggagatgtgcaaatacagatcaccatgtgttcattcactatttggtagtccctcagaatggatttcagtgactctgtgttttaagaactcttaaaattctcctcccgtttttttggcagagagccaatgaaacattacggtattagttcattttcttcttgcttgtcttgcagtagtttataatgcactgtgttattgaagaacaaatgtatgaacatatcttggaaataatatttgtcaagcattaactcaaagatctttactacctttacagaaaaaaaaaatagctcttttctttttccttttgcaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactg

SEQ ID NO: 14012 - DNA, 1131 bp, Homo sapiens
tctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaatgtgatcatgtgattacttcatatgcagtgatcactagagcaaaacttacagagcaatgtaagaacccttgcttagaacattacttactctgatgggcagttattgttgatggagggacagaaaaatagatctaactggaagatgaactaccggaattaactcagccctcaagctatgtccctggttttctgaaaacagccaacaggaagtctcctaggctgaaatcataaaactgcagacaatccagcaaaaatctacaaactcacctagttcattcttgaaatacttcttgtatttgttatttatgaacccctgcctgcttccaaaaagaacttgcagcattttgtattaaaagacgcatgtgtataatactttaaacttttagagtaaaatatcaagactctcatgttggggagtggggaacgaggaacagaacaataacgcattaaagtaaataactctggataaaagtaattatttttcaag

SEQ ID NO: 14013 - DNA, 1202 bp, Homo sapiens
tgtgaaacagggattcaaacagtttctcatatcactgtgatgattaaatcggtacatgtgaagtgcctaacctatggtaggtgctcagagaaggttagcttctttccttgataataaagtcttaactattaaaaaaaaagccatggtatatttatacaccatattttgtctattctaagacatattttaacacctctgaatttccatgcatattacaaccaatggtgacttgtcaaagagatggcagtgatgaaacagttgtcactgccttcatgtgcagtttgttttccttttcatgtatatacagagtgatatatgatacttacatgtgtcatttcaaacatagcatacttttttaatgacacacacattgacagtgtgttttataactgatggcaccttaaattcaatgagataacaacataagaagagcctctttgttctaagcataatggcacatgtcttatttatcatttcatatattctttttgcagactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaaggtaatttcctgggaagaaaaactaggaacaaaaaagatatatataagtctctgatacttacatatatttggagaacgtgttggagaattggaagggaaagtcggcattcaaaaatgcaaagcaacttcactttataacagcctgctctcacaggaagtgatacttccagaaaaataagtttgtattgagcatgcactacatgcaaggcaattttattttatatgggatattggacctaataagaagaggagcttgatgaattttaggcagaatgacttaagggctgtagactaaataaaaagcaaaaaggatagggacatttctatgtgttttgatatgaaataaaaaactaataataaggcttacaaacgtaagtcatcccaactggcctcacaaaactcaagtgtggtgccaggtagagagccaaatagcagtggaagatttggatggtaggtcaggttcccatttattatgtttagtctagtacaaggaata

SEQ ID NO: 14014 - DNA, 1168 bp, Homo sapiens
ggaagattaaataaaatgcgtggtctcacttggcacagtgactttttttaagcactcttaaacctagtgggtacttaataaatgttagttctgtctccccttttattctttgaataatagctattagcatgtgaggaaaaccttgttttgttttttcttcccctgcctcctccccatcacctttccccaattctaggtcagataaccctcaggaatagaacaaacctgaaaattaacctgttaaacaggaaataccattaagtttcttgcaacttaaggtttaattctttaattgttttgcatataattttattttctattactttgtttcaggtaaaccataatggaatgcctgaaggcaaatttatatggcaactaagattaaaatgaaatttaatctttaagattcaatttaattatttaatcatttaagattaaaatgaaattttaagttcagaatatttttgcaaaagcacaccttttaaaattatttgcaagtaggtatgagatagttttaccaacattttaatgtgttggtttttaaaaattgctacagctgtgaaaaaattgaaagatatggagtatctgggaacagtagccagtatttgccttcattctgactatgctgctgcactttttgaaggcaaagtccagttacatttggtaagtataattttgatgtcctggagacgcgctaagttataatgaacagcctaatgtctgattatcaagaatattggtcaggaagcaaggatgtacagactaactagaaagccaagtgtgagtaaaggattaacaaaacccttccccttctatattagaagttctgttgactttctaaccctgttccccaaaaacctgataaataccaacagtgctactcacaacatagcctttagtaaaacagtaataataataataattaccctgttggtaaattggagctagaaggaactatacatgaactataaaaacctgatgggaatgccatacctttgggcttcctggaaggtgttgactcataatcgggcattttgtgtgggggggtctttgaaaccatgcctgctgagttgttcaagagatgttggcacctgtgaagagggggcttctaagtcagggcatctctcacatctgtttcatggctctttacatctaggaagacaaagag

SEQ ID NO: 14015 - DNA, 1380 bp, Homo sapiens
aatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactatggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttgcctgctgagtcacgaccctgtctttgttaaagtccatcttgaaattcttatgcttcaggaaaggttttctcaccagtagggtgaggctggctttcctattcatgttcttccatttctatgccttttggatatgcaagtcacgtctccctaggtcttctgcagcccccaggagagagacttgaatctccatgcagccaggatgcggcatagtgtccttcacttgttcattatgattttgtttgtaattttaaatgttttaaacccaagattgggataatatgtgtgtaaaattaatagcatttcttttagaattagaaattgtaaatatgccctttatgaggatggcataggtctgattcctctttgaagccctcgtgaccatgaggtgaatgagtgagattcatggtaggaggcagttggtggttctgcagcagtttggatgtgaatc

SEQ ID NO: 14016 - DNA, 1101 bp, Homo sapiens
agtaacagtattaggaaatgtgagggaagcattcatatatgattttgtgtgttataatcagggaccaaaaggtgttatacacattcacacacttgagatagggaatttcattgccttatactgatgcttttaatattttggaacttggaacgagtcatatttatgaacacaaagaaacattctgttgcctgggccttaagagtagggtggaagtagaatccacgtatgtttttcagtcactgatgtaggtaagtagaaaatttcctttgggcacattgatgtgtacccattaccctcatgctgtggtgctgggctttctaaactacaccagctggctgtcaaatagtaggcattccattcagcattattgaaattggattgaactctgcctgattaactcagtgctgttatgcacagtatgacttgagttgatactttgctgttgactatgtctcttttgttgtggtttcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtaaatcatgtcactcactggttcttcgtcactttctattaccaggtttgtactgacaatacttcggaggtgttttagatgctttaagatttacttctttttcccctcaaatgcttgttgcttcttatggcctatattttccaaagatactatttgaatgcagtattaagagtagacttctgggcttgactttacaatttgtatttttatctttgctttatgctcagtggaaaagcaagaagtgaaatttgaggagcaaatataaatatattctttataaaggatgagtggatgagtctagggaattaaaagttgagcggtgagctctggtggtaatgggttgtaaaaataaaatatgtttattggctgaggatttgtacaaattttctttttcttagtctacctaatctgtgga

SEQ ID NO: 14017 - DNA, 1216 bp, Homo sapiens
gataagaagtgattctgattttaaagtacattgtttcgaaacattaacagaaacatcaaaatgataggagtatacctgcttctattaaattcttgttgggaaagttcttaagaacaagcagtttcctgaatagcaagagtttctacagatggattgcatttggttgtttatttatagttatgcaagttaactagtagtttagatatgaagagggcataatggaaaatagtatgaatgggtaattttaatagctttgctaacagtgttggatgtatgtttttcactgcttgttttgtaagtttattaaacgttagccatatcaaaatttcttaggatctaatttcaggtggtgcttatttgctgtaaatttccagcaaactttccatgccaaggttatttatgatgtgaaatgagaaaaatcaacttcctgcagttttgatgccaaatgtttctttggaaagctaccatgtaatttcctctctgcttgaacattttggtttttagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggtgggtactgctttgttctcaacaccatgacacctcctgcctgccttggcacactcttgatgtgatttgccctttactcagagttaaatgaaggaaagaaatagaaaagtaatttcttgcctacattatttcttctccacagaagtgttattggctctgacaccaggattttggttttccaatggaaggcatagttcctgtttacttgacttttttttagtgtatttaagtttaagtctttttttatttttgaagatagaaacaaatgcagttttctttttcttccagtccgaagtattcctatatatgccactgtatacaccatcttaggtttttttaaattggtgtttttagaaaaagaatcagcggcctgttgggtaggattgtgtttagctccaaacagcagaatatctgattaaccgtggattaaacagctgctaatttttctcacaagaattctggaggtattgctgggatagttcggcatctcaacgatgtggttcctccatctgtccttattgtgttaactttt

SEQ ID NO: 14018 - DNA, 1212 bp, Homo sapiens
cactggcctttattattgggcatgggcgctctgaagggataggatccccccaccccacgcccaaacccgttcgccccgccgctcacccggggccccagggtgcgggctgcatccccgcagcgtagagacatttcctctttaggactagcgcagtgcaggggttgagggatcgctaactcccgggaaaggacaggtcgaaattacgtcgctccatttatgacaagcagccaagctgctccacgattggctgctttagccttacgtgcgtcgcgcactcatgacgcaatacgcaggccccttacgcgatacaagtacgtaatgacgacagacgttctttctttgctgcgtctactgcgaggtaaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatggtatgagacttgatgtcttttacttacatctttactgcacgttccaagcgttgtgtggcctgacgagtgtgttctctcttctagtcgacattactctgaagggacgcacagttatcgtgaagggccccagaggaaccctgcggagggacttcaatcacatcaatgtagaactcagccttcttggaaagaaaaaaaagagggtgagggtttttcttctgataattcagttgctcgttggaaggtggtttataacagcatcacatttggttgctttaacaattttcgaattaaggttcagtgcttcagctttaaatgttgctgtccagaataccagcctgttcagtgaaattgaaaaac

SEQ ID NO: 14019 - DNA, 1191 bp, Homo sapiens
acatcataataggcatttcaataataagaatttgagaaaaaattctacagaaaaattaagagaagcacagccacttactatttgtgcttccattcactggttttacttacttttttcctcaaacctattctgcaccctgcctcacatgaagaaaagtgccatttactatttatgtttttattttatgtactattttatttaccaaaatggattttattctctgttgtattctcatagcatctaccattattctaggtaaattgtaagctcctagtaattgttgggtttgtttaaaggcggaacatttattaaagagtttgaaaacaacatatgttagtgacaacattcagcttactggatcctttgtcttctacaccccttctttcacctaggcaaaatgatgtaatagatatagggacctttctttttttagtttgaagatttcattttcttgtagttctacttaaactgttttatttctgttactgaaaaactcaagtgtgctttatattctaggtccggtttatcactaaaatatggcatcctaatattagttccgtcacaggggctatttgtttggatatcctgaaagatcaatggtaagagattttgaattcaccttctctccttctcatatgaataccaagactgtaagagtgttaaatgtgtaattgcctcaaaacatatattatactttatcttgtttgggcagtaactttaaaagtctcttaagtgcataactgaaaatgcattataattgagatcacaatccatatttaaatagaaacttgttagataatgttagatgctagctttacactttgaaaagccttggatttcatttgttattttggtaaatttgattctttgctatcttaagaagatatttgtgaaagactaaaaaagtagaaagtaagtattgaagtagtcatatcccccttagatggaatgtaagttacaaaattgttgcaggttgtgttaattgagcacagttaagattttggtttatgaattctaacaaggagcacctttgtaggtgatgtcttcatttggatagcggtattgtgctttcactttttttgtctgatttgctctgcacagcattaaatgttttaagagttcctactctggagccaccaggttcacatcttggctctccagtttaccaagctgcatggttatgagcaaatt

SEQ ID NO: 14020 - DNA, 1432 bp, Homo sapiens
gctgaggtgagagaatcccttgggcccaggaggtcgaggctgcagtgagcgatagtcatgccactgcactccagccttggtgatagagcaagaccctgtctcaaaaaaaaaaaaaaaaaaaaaaaaaaggaaaataagagaaaatctagttttggtaaacatattttctgttttcaaagtcagtgatttttttatttttactaattactgtcattgattttagaagctttccatgcactgcaaatgtaaatcaacttacagaaaagaaacaaggtgttaattcccagtataaagagtgaatgattcagtattgtttaaatgtttccttgagatttaatttcctgtccccttttcttctctacagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgct

SEQ ID NO: 14021 - DNA, 1672 bp, Homo sapiens
ccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatacaccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattaca

SEQ ID NO: 14022 - DNA, 3398 bp, Homo sapiens
caggcttcccagatcgcttgagctcaggagttgaagaccagcctgggcaacataatgagatcccgtctgtacaaataatttaaaaattagccagccatggtggtgtgcgcctatagttctagctatttgggaggctcaggctggacgctgagcctggaggaccacttgaacccaggagttggggctgagtgagccatgatcgtgccactgtacttcagcctgagtgacagagtgagatcctgatgcttaagtttaaaaaaaaaaaaaaagattttagataacaactatggaaatgaaatcattttcgtttggtttatatcttctccacatcttttctaactttgcgttctattcttaaccctaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcattatatagtagtgtggagccctgaatattcatgtacccctggtatgtcacaagttgataaaatgtctctgcatattttctgttgagatgctggagtctgaatatcctaattagaaatcaaaagccaccttcaaacttcctggctgggtactctgaggtagcttacagtggctaaggaagaacatagtggatgataaattctgaggcacattcggaatttccaaacgaggtttgttttagggggtggctttttttttgaaatgagatcttaccctgttgcccaggctggagtgcaatgacatgatcatggctcactgtagcaatcctcctgccccaggctcctagaaaagtgctgggattacaggcctgagccaccagacctggccaagaagttatttttttaacctaaga

SEQ ID NO: 14023 - DNA, 1152 bp, Homo sapiens
cgatctcggcttaccgcagcctctgcctcccgagttcaagcgattctcctgccataacctcctgagtagctggcattacaggcgcatgccacccggcctagctaattttgtatttttgtagagacagggtttcaccatgttggccaggcgggttcgaacttctgacctcaggtgatccacccactttggcctcccaaagtgctgggatgaggctcacaggcatgagtcaccacacccggcccgaatttatgatgtggtggaattcagtgaataaatttaatgaataaactgcattgaaccgtatgaaaacatgtgtgtgctttatttatggtgtgatttaggaaatttatctttgacatttgcctaagtctgcgtgccatcagtttaatttaaagctagacttatggtatggctttgattgttttgattgtttgataaattggtatatgtgttagcacaagtgtatttattattgcaaggcacaatacctaaaaagccttattgagataattaaaatactcatgttcctttgattggtgtttcttttttctttttcttttttttttttaataggacttctgtaacgataagagttatatttcagaagagacaagagtacttctgttaacaggaaaggtattatttacttaataattttgagatctttgtttcatgtgtatcttgcttctgctattcctagaaatacctttaaatgaccactagattgtatagttcctgattcttagggatcacattatggatttaaagcatctaaagcagccatgcttttagaatttttctgccagcaaccactcctctgaaatgccactgtgtgttctcatcagtaatgttaagcacagtttatttacaattcacaaagaagactttcctgggaaatggtataaccaacttaggtatataagataaaagaaataattttatactactaatgaattagacaattcatgttctatgtaagtaatatggtgacacctaaaacagcaaaaggaaatttagttttttgtaaatagttcctaaactattactatatatatatccaatagtttatttataggagcatttattatgtatgtattttgctatattttaggggaactttgtattttgattgaataataaaggatacattaa

SEQ ID NO: 14024 - DNA, 1308 bp, Homo sapiens
cataaaaaaggagccatgtgttttgtgttctaagtagcagagtagactaagaggtgaagaagaaaataggacaaaggctgtctgttagttgtgtcaaggaataactggaagctaccacaccatacagtatttctgattagccataactaactgcaaggacggctaggagatgtatctctattctgtgtagctagcatatttaccccagaatttaattttttttttcttttgcgggaagtaattcttttttaatggattaaaaccattgtctgtacttctaaagctgtatctgttttttcaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgtgagtacattttttctcccgtggtaaatacaaaagtttctaagtatgggaaccataaaatcattgttttccttctgtgtaggaagataggagggaagaaagacaactttgatttagaagctacttttctgtgtcctcctctgctttgtctttcccttgcttcacacccctctcccaccattagaatgcaggcagcagaataaactgaaactacatgtttgtttataacaaaagtattttaagatattaagaatcaaaagttatcacagaatttagtgttttattatatttatgactaatgtctttctaatccatgtatattcatctttttttctataaatgggttataaattcaataactgtcactttgctatcctaccaaaaaatggggcaaatagttcactttggcatcttaaaaaggttaaggtgaaacttgtgctgagatgttatatttagacttaaaatatgcagaagacatcttttgaaggaaacaatacattgcaaatggcagttgaatcatatgttcagggtattggcaattagttcagagtatattcaactacataccattttcctcacatgataatcatagaacaagcagtctcctgaagtttttattaaatttgtgagctaatagtttaacttgtgaaataattcagtgtccattgtacattctcttcattctccgcattgttctggctaataataaaaagttaccacaattagtccctgccctcaaggagtttatagactagaaataataaattttatacattattagaaaaagatcactgacacaataggatagtttttgatgagtttttcaagggaggaaatcctatacat

SEQ ID NO: 14025 - DNA, 1235 bp, Homo sapiens
tactcaggatgctaaggcaggaggatcactttagcccagaaatttgagaccagcctaggcaacgtaacgaaaccccatttctttaaaaagaaaaaagtagatcatttagcaatatttgcattggaaaatttctaaataggaacagattcaaaattgtttgtaggctgggcgcggtggctcacgcctgtaatcccagcactttggggggccgaggcgggcggatcatgaggtcaggagatcgagaccatcctggctaacagggtgaaaccccgtctctactaaaaataaaaaattagccgggcgtgcgggcgcctgtagtcccagctacttgggaggctgaggcaggagaatggtgtgaacctgggaggcggagcttgcagtgagccaagatcctgccactgcactccagcctaggcgacagagtgagactccgtctcaaaaaaaaaataaaattgtttgtaaagcctcttttgaagagaaatagtgtgccagtttataaaggcacacataagactgtacaacctaatgaagccaaggcagtctttggagattagtacagagttttgttatcttgctcatctaataaattttatgctttttagtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaagtgagtttaatatgttggtagaatggttgagtgtaaaactactttttacttaaaaaatgtctatttaatattttagtaatttcttatttttatgtatttacttcataaataaaattaagtttattcaacttgattaatcatttatttctaagtttagagatagctttttacatatttttatgtactgtgtttaaacaagactgtccacgattataaggtagccttataatatgaaataggcatgaactttggagttagagaccaaatgttcactctgccctttattagatgtgtattcttacataggttcattaaggtcttgtgcgcttcagttttatataaaaaggaaaaataatagtgcctttcccacaggattatcatgtagattaaataaaataatgaatataaagcatcctagcccaatgtgtggcaagagagcactattgagttaactgctagttactttcctttttacaccact

SEQ ID NO: 14026 - DNA, 4378 bp, Homo sapiens
ataagggtcaatactttggtagtaaatattatattaagcgtaggtacttggaattgattacaaggtatattccttagctaatttgaaattttcatctttaaaataactcttttctcatttctgcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacagtccagtgtgaggaaatccttcatttgatgtattagagttagtgggttaaatattttaaaatattttcatgtctaactttgtaatttcagggggaaagtgtcatgaaaattttatttctgtaccaaaacttttcttctggtttacgttttctgtagcaaataagagtctacttttgaaccagataaatgga

SEQ ID NO: 14027 - DNA, 1946 bp, Homo sapiens
gattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagaccttattttaaattgtgttttctttatactgatttattttttctaaaaaaattaggaaaacccttacagcatagaaaggattggctaattcgatattttccg

SEQ ID NO: 14028 - DNA, 1140 bp, Homo sapiens
attcagtgtgctgtttagtttgggtaagaatcactggacgaagaaagataccgtgaatcccttttttctggtgctctgggggtttacttggccaaatgggttttgggccaccaggtgtcctgtatttgggctagatgtaagaagtatggacggcactgtccctccccacagtgaactcacagccacgtagcataatggagaatgggacccacatcacaccccatgacagcagtgtagttcagagcaagaatgacctccagaacagggtagccatgcagtgatggcctcttcagacatttgggcaaggttccgcctttcgagaaaaacacaggtcctttctgaattcggcctggctatactttctgaatgccagttcctatgtgctgccactcttaagcttgatcctgggatctcctgattggatgccgcataatgtctcttgcagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatggtgagttatcccggtacaggctgttgagccctcccgcctctgctcatctctaatatgccatacattatagcagaatcactcacggaaatgaaaaaagtcgaatccctaaagtaatgctttactttataacgccgtcattcctagggccagaatcagttatgataaacagattacatctccaaaggccagaactcctgaaagaagtggggccagatagaggctccgatgagtttcataaccaccaccttgacgacggtcaatccttgatcccaaatcaatttcatgtgtgaaatgttggtcgtgtatgagttggtactgtttgggttcaattcagtactttaaaaatcaatacattgaatgacttttgtttccagtgattggtttctgtacaccgttcttatatattttatttatatctgttaactcagtccttccgacaactctgttaggtagttgttagttctgttttatttatgagaaaatagagactttagggaagttagagaatgggcctc

SEQ ID NO: 14029 - DNA, 1366 bp, Homo sapiens
aaattaaagactccatcaaaaggactgctccatacactcaaggaacacccaccaacaaatcccgtctccacaaccaccagattatctcaccggcgagtgagactgcaaggtttgggggcccggccgtaccactccgcgctgcgcacggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcct

SEQ ID NO: 14030 - DNA, 1240 bp, Homo sapiens
aacgttcatagttgtgtttttgttgttgggtttttttgtttttgttttttttaacttttccaaaaccaggtacaaagtgagagaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatagccacagctgattctcattttcttttaccctctcctcaatatgtcaggttattttggtagtaatatatgaatgtcttccacataagtaactcatacagtgctgccaagaattaccataaaagcattggtttgatgtgtctttggatttttttttgcatttgtattccctatgtatacctgtagaaactaatttttaaagatttttaaataggcaaattttgtagcacaattttagacttataaaaatattgaagacaaaaagaaaatactggacattgtagaagtcccataaacccaccacccagtttcctctattgtattaagcggggttttctagaggacagaactaataggatatatgtatgtataaaggggagtttattaaggagtgttgacccacacgatcacaaggtaaagtcccatggtaggccctctgcaagctgaggagcaaggaagccagtccgagtctcaaaacctcaaaagtaggaaaa

SEQ ID NO: 14031 - DNA, 1265 bp, Homo sapiens
aatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtg

SEQ ID NO: 14032 - DNA, 1172 bp, Homo sapiens
ggtgctgccaaatagcagctcttcaataaactaaagctgttgttattagtaattatatttaattattatggtttagaactatggggttcattttattataatgattaattgataacaactaattaacatagaacttgtccttattgccaaccctagttttaaaatgttgtgcttatttgtttatcttttgagatgccatctttaaagtttggaggcatgaagtttctgtcttgctgatatgaatgcttttcttttagcaacacttcttgttgctgtaaatgaacttcgtaggaatgctcgggctaaaggaatgtcattttacaagtatggtatgtattttagaaaccaagtgtttgtttcacctcccttatttgcttaaaattacttagtactgttattgctttgttcctaatagaaatgtacaaaatatatctgaatatcatccctgtgtggctcttacatatccttcagcccttattaaaaagaaatgtagtatagaaatttgaacatggatactttatatttggatttgacttaagtgaactaaggtatttctttatatggttatataacttgagaaagtaatttgactttatgtatcagttattgttgacatttaagccaagaaattatgtttgcattgagcaaggtttttaaaatcataatctctcatacacttttttatcttaacttatatcttgattttaaatggatacttattaaaatgttacctgatagtatcaagttaagattttagaaattttcttgtcttgtctcttccccaatgactagtaatggaaagtcgtgatcctagtacaaatgtgatattattggaggatactgctgcagtcttgggagttataatagcagccacttgcatgggccttacttctataacaggtaaatattccttaaattacaggtgatttatttgtcctacttaaataattctctaatatgtgggaattttctcttatatcattgaataatattaaaccaacaaattgttaaatgttaattcctactaatcattgacttatgtaagacatttggtcagcagaagtattcaggtttatttgaattaaaaatgtctctaaattagaaataaggaaggctatttgtaaaggatttctgtaatgctgtacgtctttctagctgtgacttaaaaaatt

SEQ ID NO: 14033 - DNA, 1400 bp, Homo sapiens
tcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcagttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttcttttttttttttttactattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttccc

SEQ ID NO: 14034 - DNA, 1165 bp, Homo sapiens
cgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgt

SEQ ID NO: 14035 - DNA, 1057 bp, Homo sapiens
tagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaat

SEQ ID NO: 14036 - DNA, 1212 bp, Homo sapiens
gtcatcttggtttatgacagacagtagaaatacatatttttaacatgtttgaatgttaagctgaaaattgaggactttatttatcttttgccgttggctgttggtcactgatgtgtcctttcatttgtttcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccaggtatcctgccatattccttgcaagacaactgcaacccttctttctttcacttgtctcatctgtctgtgtatttctgtactcatgtatgtgtatgtgtatatgtatgtgtgggctttttttgttttttggccagtgatgtagaaaagttggaaaaaacagacatgctcaagagcttctcagcccgtccagtgccaaacagaaattttaggaggagccactagcctgtttacttccagccaccgtgttcttgtgtataggcctgaacaccatagtcctattaaaaggtgtgtctgtcaatataaaaataatttcttgatgtgctgctttgacattgaaataggtcaagtgctataagcctgttttcttaaaaggtggtcctcttcctttaaaatgggttttgaatttttaaaaactttgatcctatgcattttattagtcaatgatagaaattaaagtgaaatactttgagaggcaggactcaagtagtactgaacaaatgaaatggtctcttc

SEQ ID NO: 14037 - DNA, 1573 bp, Homo sapiens
tagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaacct

SEQ ID NO: 14038 - DNA, 1139 bp, Homo sapiens
agaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagagg

SEQ ID NO: 14039 - DNA, 1235 bp, Homo sapiens
ttctaatgaaatcagttctttaacatcaaagattaatttgtttataggacctctaacatggcagttagtaggttaagtcataatttaacaaatgttattcaggtgtttattcttttcagccttcactttcaaaaggtaagcaattattattagttctcccttagttctggaagaaggtttaaaatctagtcatccacaaatgaatagctttggtaacttggtaaaagactttttggagtctgagccacccttcttagggcactttatttcctgggattgccaggacattagaggtgtatctcacaggacagtattttgctaggacaatcgaagtgtaaccaacagtttatttgcactccagtacttcccagctagttgaagtccatgcccttgattctaccttgtcatggtcatcttgtatttctgcaggggatatcttgtaccccccaattaaaaattaattaaatttctgttgattttcaatcagtggctagaatagagactgacatctcctctttcatatagttgaaaatttacccctattttttctttggtttttgacatgagagcaacaaatgggaaaataccttggttgtgttttatttatttctgtgataggaatctctttttcagaagaacaaaataaaaatgctaaaagcaatttcaaaataagtttcttttctactcttttctggcacctatggaattaaacattttagaaagaagacaggtaggatataatcaagtatgataagatgaattttattacaaatattattttacctagggttgtcagtgtagttaacataaatatgcatgctaataaataacctaggctgcttgctcagaaaataaacagaaagtcaggagataataatgtactacttcactctaaacctttaaaatgtcttattttcctaataaacaatcattatttcaagattgtgctaacctacctggattattgtaattcttacttttcctatttttgacagacaaatcaccagccaggattacccataataatagcattttcagtcatctcacaggtcaatggcacacctaacctaggcatcccattttgagataaagaaggacagaatttaaagtgttgccaaaagtcatccagcccaaaagagctgaagttatttaataattagaattatagaagtaattagaatcactaaaagttggttcagtgatgaaatcatgataaatattcaaaaattaacatc

SEQ ID NO: 14040 - DNA, 1306 bp, Homo sapiens
tgaatacatcctgtgaagtcttgtgtgtccacctaattatccaacccgttgtaattgacacatctgtgccatggagtattttccaaaaatgagttaaatatctctgctattcattaaagtatttatggcatgttgagtggaaaaccaagtggcagagaaattttaaaagggaaagaaaaaacaagaatgtccatgtttgtctagagaaaggtgtgcgaggattcatcagttagtactccttactgtgagaaactggccttgagaagaggaatgtcagcttttaccttgtatacatacctgtcttgctggaaacatgtattgattttgtcatttggtagaaaacattgaatatgtatttaaaagtttcttagatgtgtacatttgggcagtatgccacatttttctaagtatttctccaataatgaattgagagagaacatttgggtggagaggagaatgcactgtttggctggagacaaagattcgcaaaaggtcggttggagaaaggaggtaaataagtttgaatgtggagagaaaactgatcagagcaaggttgagggaaaatgagcacgtacagaagatggaggcgtcaagcagatttgaaggaggacggcagaagtgcagcagatttggaggcggttttccatgtaagtgccactggcttccactatccgttattgagtgaagactctctggcataatctgttggatctgagaagcctgttgtgacacttcccatgtgttaaatggcacccaacaaagtggatcagggctattttttacatgtgaactaacaaacatctgtaaagtcacagcatgttgaggagggctagattaaattacagagctggaaggagtggccctgagctgataccagagaacagtttgtgttagtgcctctgagggttacataaccatttctaactgcttgcactgaaaattggtttagtcacttataaaactgagatgtctattttaagcaaatgttaaaatagttcattggcatctttttctgtagctattttttaattcagttatagttcacataccatataactcaccatgttgaaggatacagttcaggggtgtttagtgcattcacaaggttatgcaccgatcaccacaaccttaattctagaacattttcattaatccaaaaagaaaccctatacatgtaaacagtcagtctttctttcttccttgaatcccttgcaatcactaacctaccttttgtctccatggatttgtctgttcttggcatcttatgtacatgggatcatacaatacgtggccctttgtgtctggg

SEQ ID NO: 14041 - DNA, 1245 bp, Homo sapiens
tcttcttgatcctcctttttaaaaactctgataaacttcagcttctctccacactctgcatttgctcaaacattgtagtgctttgattaccggtccacatgcctattaaccaaacgagcagctcaggcttggctggatggctggggctacatgtgtgaagggtgcatgtgatagagcccgatataaatggtaacagattctgaaccgtagattccagcaggcatatgtcatcagttactgtgcattgtacttgcttgttatgagttctccatgccctttttcagagacttcaaagcatttaatatggaatatatcagcatcagtcttgtataacctgatattttctcttcaatttgtgttttaaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaatactttgggatgttaaattcattggaaaaacaaaccatttgtaacctcagttaactttaacaacaagcattctgagcaaatgaaaag

SEQ ID NO: 14042 - DNA, 1920 bp, Homo sapiens
ttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaattgtcatcactcttgtaaacatttgccaaatccaactgtaattagtaccagaacttagaaggaaagtcacaaagcatgccttttaccagaatattgctttgccttttcttatatggaaaatcactgatgtcatatcatttattatcctcacagcagctggcattcattccctgaaatcgtcgtctcctgataaacaataatttagagatatgttcacttgtaaataaaaaggttagaatctaaggacaaagaatgatccaaaaatactaaggaaaaagaacaattttcaattttcagaaatgaattatctgtacatatgaatagaggaaaatactgagtgctaatgttacagggccacaatctcatatccacaattccaaaatctccaaacctctgaaaactgaaatatttttcataaattaggcgtaaattctatgccctgaac

SEQ ID NO: 14043 - DNA, 1145 bp, Homo sapiens
ggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaatctagaatatttattattagctaaaatattcaggagcctataattttaagttaggcattagtgtcaatgtatgaaattctgatacttcatgtggaagacagtcattgatggatacctaaaagtatctaaaaagtagatatgttttttttattattattatatttttattattattacacttcaagttttagggtacatgtgcacagcatgcaggtttgttacatatgtatacatgtgccatgttggtgtgctgcacccattaacttgtcatttagcattagctatatctccaaatgctatccctcccccctccccccaccccacaacagtccccggtgtgtgatgttttccttcctgtgtccatgtgttctcattgttcaattcctacctat

SEQ ID NO: 14044 - DNA, 2383 bp, Homo sapiens
tacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttc

SEQ ID NO: 14045 - DNA, 1221 bp, Homo sapiens
caaaatgaagaatatcctttactgaaatggaacatcacaggtccctagaatggaatgggttttgttagtatagctgtcacaagtgtgtgcctcttgttacattaatgctatccctgcttttgttagttccatataaatgattgatttggcttgaatggagataaaagtctaggtctacaaccaatcctagaacttcaagttaactttaagtttggtgttgtatatggacaggctgttacactacccattttactgtgcatattaaacgttactgttacttatttttagtggctagatgattgtaagaggacatttggtgccaaagaagacatgtataggataaacacagatgcacaagtaagtttcttgttcctgtttttgcaacatacattttctgtatcaggtaaaacaatgcatgtgttcaaatatccttatttgattatttctaaaaataaagaatatttgtaaaacttttcattttggttatcaaaacaatctttgtaaaagctcaatgaaatactggtttcataatgaaaaattcactttaataaaaatgaacgaccagcttgtgactgaagcttaataacatccaatagataagcttgatggatatctggacagtccaggtcggcttttaagttgcatgtgcctcttaaagaaaaatttgtcccatgttagtattctgctattctgttagataaattggtcaagaaagcaaacctaagaataatgtgatataatatatccatgttaaaggtaaaattagaattggataaattataatgtttttctttaatataaggctcagtgaaaacaacagcattatattttcttagaaaggtgcacatacataaacacatacattgtagtaagtgaggataagttagggcctacaaattattccaatggaagtgtagcttcacaggggaaaatacattcatcaactgaaatttatttccatttgacatcagaattccagtcttttatattctacctttggttatattattacagatttctagtgtctgtaaaggttatactattattaggttatactatttattatagtaaaaaattgaagttctgcaaaaactgcagtgttgagaaaataatagtatactcgctaagtgttaactatttgccagcctctatagtttctttatccttacaactcaggcaagtagttgctctaattatcctggttttgaagatgaggaaact

SEQ ID NO: 14046 - DNA, 1186 bp, Homo sapiens
tagaacctaatcctcatatagttgtgaagactgaatgaaattatccatatgaggcccctaacatagcccttaacacaaatgaccatgatcaaaactttaagaatattattatcaccaatgtgaggctgttcaaataaaagcctccaaaattgaccattgaaaatgaaagcattctaatcggtattattcatagaagttactaaaatgaatccatagtggtggcatattataggacttgggttattttaaggtagttgcttgaaattagagttctaattctaaaaatgctaactagaaagaacaggaattcacttattcacactttcttacaagatttaggttgttgtacattttctaaatcagtgtgtatgatgaataaaaataacctgtcaaatgacttaagctgtcttacgtgattgagcctattctttttttctgagatagtgttatgatatttatgatatctgtgttaatagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcaggtcagtgaggttcagggtttctgaattcatattatagttacctaatcaagttacagtttttcttctaaaatcagcatctccgattttaatattcctaccagttttaacaaattttttttttctaagctaatggtattacttacattgacactgtgacattgtggtactgctggtacattacacaatgactggtagagatttctcccctaaggcaattagaataaaacttcaaaacaacgtctgatatgttttctgcagtatgcttaggcaccatcaggataccaaagaaataaaggcctaagctctgccttcagggagcttacagttaatatatcataaatcagcttataatcaaggcttaaagtaatggactaaaagtgtccattgactttgtgaggaccttaaagtttttagctgttaaggttgcttcctccccaataataaagataatacaagctaaaatttattgagtacccactacttgctaggcactgtgctaaag

SEQ ID NO: 14047 - DNA, 1220 bp, Homo sapiens
tagtttgtcatatcagggcctaagaaaaattgtagggattatatccttacaaaaggaggagcagcttagaataacagaaacataacttatataaatccttaagtgggagaaattgaaatttgtcatatttcctcttgaccttttaaaattggcaacagttatgttttgatggctgtgatcttgattttaaattatattttgtagcaaaaaatgaccattgaatttagccagagctatcctaccaactgaaataattgtgaccttgtatgttgtcaagtgcatgtgggtatttaaagtcagtttttgcattgtactaagtattaaacctttgtaaatcttgaagattttcttaaagtttgtgttgccaaagtgtatcatagaaatgttgttttaagtgtctgtctctgactttttcacaacatattttgcataaaaaaagatttgaatcacatgttgactttctgcacaaagcttaatccagagcttgaatcagtctttgggtttgagaaatcacaaagagtttgccccaaaagtgtagtgtatatttaaatgtttgtcttcgtttttttctaattctgtgtgttttcctttttgctaaccaggagctgcaggtaagttgcagcctggtgttatggattgtttatttgttgtcatctgtgatgtatttgtcttctttgtggtctcattcatgtttgtgtattagaatagaaatggcttagatagtagatttacttggtccccagtaatacaagatagaaagtcaagaaaattatttcgttaaaacaggttgtcaaccaaataattttgatctttttaaatataaatatttgatggtgtgttaacagtttaaagaaattgaagggctgattgaaactctgcttttaatgatgcattaagtatttttcatcttggtatatgtttttctggtatattacatttagtacatttagaagcatgtatttgaggttttagaaatcgtgtcttgcttttccagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatggtatacaattcacttttcttac

SEQ ID NO: 14048 - DNA, 1254 bp, Homo sapiens
tatggcttaatatgtgccacacttaggtagtatggtaaagatgtaaaggtacctaggctttggatctaaacagacctatactcaaatctcagttcttgttagggcttgtaccttgggcaagttactaatcttttttctcaccattaaaatgagaattgtgtttagaagtttgttatgaggactaactatttatgtaaaattctagatacaatgcatttgtccaaccccaagttcacaaaagtctggtcatcccctttttgtaattataatttgactctcatgtgcttttattcaaatgagagagaaacataacttttcatcatagcaacaaacttaaaataatgtcttttacttattattgcttggaatcatcaattatttatgcttttttcctagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaaga

SEQ ID NO: 14049 - DNA, 3075 bp, Homo sapiens
ccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaacagatgtgtaaattttttcttctctcttctggctttcatttcaaaaacca

SEQ ID NO: 14050 - DNA, 1114 bp, Homo sapiens
ataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagag

SEQ ID NO: 14051 - DNA, 1214 bp, Homo sapiens
tgatttatttggcagagagagtcacattcagtattgctcagtgggacaggggctccgtggtgatatgttgctaactaaacaggtcaggcattcgtagccactctgggtaagtgcccggtggttaggtaatgtgtgacagccagcagccaaagtggacatactcagagacagttcctggctggctgcccaagccttacatctgtagctaaagaattactgaaaatgtgaatgaaaatatctcctctcctggcttgtggtccagagctcagactcaggaaccgaatttacataggtttgaatcccagatctgctcttattggctgagtgagcttgggcaggttccctacatttttttcatgtgtagaatggggatattaagagtaatctgccttggggtggcaggcaagattaaatgaatatgtagatgtgaagttctctgaatgagtggcacctactgctaacttttcccctgcttcccaagtttattcagtgagcaaatttatcaagtgccttctatacaaccagacattctactaggtgctggcaaatgaatcagacctaattgctgcccttataaagcttatggcatagtacaggggttggtaagcttttctgtaaatgtctggacagtaaatgctttagactttgtgggccgtagtgtctctatcacagctacgcaattctgctgttaatattgtgaaagtagttgccataagtaaatgaatgatcatggctgtgttgcagtaaaactttatttatgacaacaattggtgggtcatattctgcccataggctgtaatttgcagacctgtggtctagtgggaagacagttgttaaataattacaattatgatgttacagattgtgctaagggctgtggaggaacagacaggattctatgagtgggaagggtcagggaaggtagctttgaagaagtgacattgaaaccaaatgatgaggagaggcagccagaggaggagatggagggtgctccaggctggtctgtgggttcgtatcttttaaaggcataacagatattctgcagctttctttggattaaaataaataatttcgttcctctatttaattcatcgccagttttctcctcccctaccctctccctgcaataatccaagagataagctatgttaccaagagataagctacattaatatattaacacattttgttctgcatatgcactttctttctct

SEQ ID NO: 14052 - DNA, 1850 bp, Homo sapiens
caaccctggagtaacctcgatgccctctccagaagggcacccgaggaagggtctagggcccaagagcaccaaaatcaccaacgccggggattggtaggtagcctgaaaaatctaattcagagaaggatgctccgcgcgcagacatggcttatccccgtgctactgcatgagccacacctaggccggccccggacaccgacagccaatggccgggcccgtcccgccccatccgggattggctgtgcgtgccgcggccctccaccccgccccgctcaggatcttcccgggattggctgagctacccgacctctccaggggatcggctgcgcgccccgcccttgcccagagtcttcccgggattggctgcgggcctcgcgaccctcctgcttccctccccgccccgcgccgcctctctggtttgtgcgcccgtcgcaggtcgcaggcctctttgtcagctggagttgcgcggtgagtgcatctccagtcttcggctttcggtctcccgcggggagggcgcccggccggcccgtgggtccgatcaggggctgggctcgcccggtgtccccacgagctttgcccgcctcgagctcctctgctcccggcggccagaacggaggggtagagcagccctcggcggcccggggggcgggcggcggtgcccgtcccggggctgcgcgaggcacaggcgccgcgcccagcggaacagccggaggttcccggcgcaggtctgggcaccgtaacaattttgcgctttgcttccccagggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggtatgttcctagccttgagcggggtgggggaaggaatgagtcagcctggagcacgtggccagtgggaccggagggttccccggcgtctgtttgtcgccaaggtccgaatccggctccccttaactggaaggaaacatccatgtaggggctcaccaaacaaaacagctgtgtttctagtgtggtttcagacttagagaagcagagatccacgaggtattgagagcaacgcggaaaatagtagtgaaccctgtaaaaatcaaagaaaaaaaatcacaaagcaccctttcctgtgcccttttaaggttgacccagtgctttaagaggctaacacagaagggtaaagtaagtctccataaaacccagagaagagactggaaagctcctctttggatcctgtctggagtcacaactgaaccagaaaaagtttcgttacaacttgagcgcctttgtgattttctttacagtttatagaacaagcaatacatttcagttttctttggttaaaacgtcattttaaaacttttctttctataggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctg

SEQ ID NO: 14053 - DNA, 1850 bp, Homo sapiens; identical to SEQ ID NO: 14052

SEQ ID NO: 14054 - DNA, 1850 bp, Homo sapiens; identical to SEQ ID NO: 14052

SEQ ID NO: 14055 - DNA, 1217 bp, Homo sapiens
attttttgagaaatagtactgattgtgatttcttctctattcagtgaggaaagggagtgacaggtaatgattctgtatcaaggctgattaaagaataaaagaaggcctttctgaagattaaaaaacaaataaaaagttgagaagaaagagcacgaagagtagaagggaacaatggtgtactcgccagcaatggcaatacgggttattaaaaagaagggtgggggcggggaaccctggccgactcaggacgccacgggaggaagccacgcaaaatagcaaaccgggatcctagaggggcggggcccacctcagcgcgcaggcgcaaccaggcccaggtggccgccgcggaagcgaagccacctatacgcgccgcgccgcttgggtctcctgcgcatgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggtacgaaacttcctgtctctgtctctcgggttctctcaggcctcccctcttggccctcaaacggccggcgtccctggcctctcgcgccgccgcttcgggcctctggttgggagtcctgtccggcctgacttaggccgagcgcggcgtgcgcgtgcccccagtccccgcggcggtctcccgcctggcccacgcccaccatgcgcatccacccctgtggcggccgggccgggctggggggctgtgaccggtcctggcccccggcttcgctgtgctttccccgaggcgtctcgatcgcctagctgctgcgctctttacccttgtttttttctgtcgattctgaggtggtggtttttggtgtctgtttttgccctgtggccttagggtgcccttcctgtcccttctttcagaaacagtcattctgtaataatagctaaataaagttaatgctgtacaactaacgtcttgtttcttgatggtcagtttgtatggaatgcacctgcaagggtacctccttgtctgaaagtcgtgctttaaaaataattaat

SEQ ID NO: 14056 - DNA, 1223 bp, Homo sapiens
tagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtga

SEQ ID NO: 14057 - DNA, 1144 bp, Homo sapiens
caatcagccatttccaggtcatgtcactttaggagggttgcttttatgacaccgcagtttcatctatgaaatggcaataataatagtactgatcatgggaggggcaatttgaagattaaatgagattaagtgtaatggtccaagcttagtgcgtgatacatggaaagcgtttaataaatgttaattctcaatagtactagatggataaattttgcttttgtttacacagaaaaaagcagccatttgggccactagtcatgaaaggcaacatattagatcttttaaaaagtgttttcagtgtctgtgaccagccattccaactactgattttggatatgcttctatagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccaggtactggctctttcttatctgcctctgggagttgagaactcacttatctaaagaagacttctcttctcgttgatccaccttagtgtagtcaatcagggagctagctgttcatagttcccccagcttcaaaaaatgtcatctgcttttgaatttgtttatttcatggtcctgaccccgtgtggcagttccatgactgcctctcatagaggtgaatgtatctgccatagattggcatttagactggactgacttaagtcagcccaaagtttcataattgcatcaagtactcgttctaagggaaacccattgggtagcttgaattatgttggttgaaaagattagcatgcagatgattcattctttgatttactattgacatatgaattgactttcccttcagctgatcaattgcaatgcatcctcaaactgtttgagatctgagaaggaaaattccagttgactgtggaacttgttatggttgtgccgttatgtagaatatttcgttagctggaaga

SEQ ID NO: 14058 - DNA, 1184 bp, Homo sapiens
agttggcattcagctattgagtacagtttttattaaggcttttgaaaaagtatacttattgaaattagggaaaatttgattatttaaaacctgggatttccagaggtgagcagggtaggatttgcatgagaaagacgcctgtttgcttaaaagaatataagtagttgttggtcacatcctcctgacaccatcaaggttgtctgaaataaagattaaagcagcttctctatgctagggcttctacttggtttggaaaaagtgttttccagaagtattataatctcacagtgggcatttctgtctttttcactcaatttacttgaaggatgcttgatttaattgctggtaccttcagatatgcaagtagtacagataggttagcaccatgctttgtattttatttaaaagatgacaaagtaagctgtacacatttgaggagaaatggtaaatcaaaatttcatgctataatacaaattatttgaggggccacatttcttttcattctagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcaggtgagtgaatcgcttcattcttctcatgttctgtctctgtgggagatgataagttttctctttcagaagagtctgtcctgaaactgcctcgactagtgcgtctgtcagaggtggattgtctgggagagtgttgggattgcatatttccccctttcatacctccacatggagatatatacatttattattagtaacaaataaatttcattttatacatttattttgagaaacttgagagaacttcagattcatgttattacttcatgctgtttctttgaaaaactgttagggacttaaaaaacatggttaactgcatgaatactttgatttaaagctattgttgataccgtttaggccagactatttaaaatattgaaaagagttgccacttccatacttaaaaagaatagagagtctcaattattcaccagaaaacccttccctcgcccacaaattggcctatccatttgaagatgggtttctttttgtaaggatctgatttcctcctttgaggctggttacctgagattaagttgctaa

SEQ ID NO: 14059 - DNA, 2388 bp, Homo sapiens
tcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaagtggagtcatttgattgttgagattcgttgagattaaactttaaagcattaaagtgcaatcatcctgacaaagttttgtacgcagttttcataaaatatgtgcagggctatcagatcacgctaggatttacatgcttcgagattcaacagatattaagaattttcatacgtgtgatattttctcattttagtct

SEQ ID NO: 14060 - DNA, 1217 bp, Homo sapiens
ggcggaaggctctggaggaagcagaagtgaaggacctcgcagtcctgggacggtggggcacagagagagaaagggagccccgggcgcggcgcggtgaggatgcgagcagaggaaggacacgcggcgccgggtacctgccgggagcgccggatccaatgggaggagggcccgcgccgcacctcaacctggcagaggacgtcacgacgccaaggcggtcgccgggccaatgggaggccgtcgcgggcagggacggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggtgagcgggccgggatggggcgagcgaggctgcagggccggctgcgccgagtaccaggctccaggcctttgaaagcgccgcactccgccggcctcggctgggggaggggagcccggcccctgctcccggggtggagggcggtcggctgcgctgttttccggtgaggcctggtcttgcccgctcctttagggaaagggagagggagagtccaagaggagcccgctataaacgttgatctccggagggccaagatgctgctccgggatgggcgttttattgatcagatgtgtcttagagtagctagaaagactcatccctaccaaaaagtttttaacagaaggctgctaggaggctttttgtattccctgaggatcatcacatcggccatttcattgttgaaatagcttatgccaaactgcttacccaaattcaacttggcactgcctgtgctttttgccaaatatggattatgaaccatgac

SEQ ID NO: 14061 - DNA, 1139 bp, Homo sapiens
ctagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaagtaagccatggcactgttgatctggaccaaaaaggcactcaactaggaataaacactctacagaggtttctcagtggccccatctgtgtgatatgcggggctacacaaaaatagcttcttttgctttgttctgttcttatacctgtctgtgatctgacttggggttggtgtgaatgtagtagagaaaggaagctgacagatgaatactgaacacaggtaatcagtttccttaattaggttgattataagctcctgaaaagcaggaactgtattttataattttacctgtttctcccgtggtgtctaggatagtaagtgagcagagcagtaaatactgtttggtttgttcagctgaggagaaacggaagaattgagactatagcatttgttgctgtgtgagaccagtggttcagaggggaggtttgggggtcacataaatgtagtttttttggagcatatttcatagaatttaaacacttagaaaagtcaagtgatttgtgtgctattttga

SEQ ID NO: 14062 - DNA, 1098 bp, Homo sapiens
ctccccctaatctgagtgtctgctttgctcaggtaacatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttatttcaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttatagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgc

SEQ ID NO: 14063 - DNA, 1842 bp, Homo sapiens
cctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaaaaaaaaaaaaaagtcttccctctgctttattctcactttcttaaaaacacttattctgggtggtactttttaggtaagaaactactgagtttcaggaaaaatgctagctactctgcagttaccgtgctttggacttgcagttatcatagttttgggagagtcagtattgtttaacaaatgcaagtgagaactagaagggttaataaagttgctccttagagtggtgtcaaaccagaaccgagacacttaaaaagtacttcattttttgaatggaaaatattggagaaaagtatgggagatgcaggtagcatgtgagtaaatactacggtctagccttcgagcatcccaaattccgggggtaacttgacagtgctgtgctctcctttgtcatttatatctggcttaggaatggaatagtaataacaagatgccagtgatttggaatagtttgttatagaacattcagtgcaaaatagtgaaaatgtttggtcttcagaagtgctgtagttgttggtcattgccttaaagcagtctgcttgacgctaggagcactgaagcagtccagctccatcaagagcactgttgaagggagaagaacccttgttcaggaagccttagaaagggatccttaaaatagtactctacgcagacaagtgaaaattcttttaaactggatattactcaacatgttttcagatgtttccactacattgaggcaaactttttaaaag

SEQ ID NO: 14064 - DNA, 1159 bp, Homo sapiens
taggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaata

SEQ ID NO: 14065 - DNA, 1156 bp, Homo sapiens
tcggcctcccgaagtgctgggattacaggtgtgagccaccgcacccggccacattagtaattttaaagtcaccatacaagattttgactactctatcttaacaaatctgtaacagttactgaaggaaagtaaaaaaaaattaagtgtggggtcctttaaatttgattttattgattaattttttatatatttcatatttacattgtggtccgttgagagagaagtctccatttttacctgcttcattttcatctgtgtataccactgccctcccaaatttttttgatgctctgacccagcataggttgatgtatcaagttaattttcaacctcattgtcctcagtaaagttaccataatttcataagttcagagattcttcatttatatatctttgatataattatttttgtgagatattattgtagagaagtttttccctgtccctccaccgagctctctaaaactccctctccccctaacacttctgtatatacacagggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttagggtaatattttttagaactgtaaatttgatgttactccaagctaatgtaaatttttaatagagtatattgcaagttattgttctgtttactattggacttttctatattgtttggtcaattgtagagagactaaagaagtttgcatttccccagtattatttttatattatttaaattaattattctgagcttatttaggaaagactagaagctttcactaatagaacgtataagtatctccaaaatgtaagggcttcattaatctgttaaaggaaaacaattataacaatttataacactttgttgttagataaaagaaaacaggatttcacagataacatgactatgttttttgtccgcaactgaaatttgaggcactaaggt

SEQ ID NO: 14066 - DNA, 1110 bp, Homo sapiens
tctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgcttttt

SEQ ID NO: 14067 - DNA, 1172 bp, Homo sapiens
tgcggaagctcgcataccccggccccttctcggctgcgggagcgactcagaagttggagcgtaccaagtcttgacggcctgggggaagcatgcagggaagggcatatgaaggctaaatgctctgaaagagaaatgaggttaagtccgttactcccattacgctactgttgggtgctggaaaataacggagatttccacgtgcagcaaatacagctttccaggcagctcttaggggaaggctagctccaccctacagcatccgtgaccccgcccctcagccgcgggaccgcccctccgccctcgctcgttggtggactcggagggggaggagcagggctgagctggccacgccacctagggacagcgcgcgccgccgcagtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggtgagcaacagggtgggggtggcgggggcgtgcgtctccatctctcggagccgcttcccgcagtcggcgttctcatgagcgcccgagggcccgggaggaccgacctctccgacctaagccagtacctgcctgtggcgtcgaccgggttgcctaggcgtgcacgaggggcacctcgcttccatgaactttagcctgtcctgcccaccctcccagccacttatgccttttaggggctctctccctccccgccccccggtgtgtgcacccatccagaggctggccagcttgtaaaccgccggtttgcttggtctagctgggtcagggctcctccccgactgcaggcgggttctagtctcccggagcctgtggctgctcctgtaataggctagtgtggcgtggcggccagtccaggtccttcaacacctaaaggttttcgcgcggggcctccaaccaccacaagcttttgtttgcaagggcagagctattgagcagattatgggtttgaaagtagttatcgctatgggaactt

SEQ ID NO: 14068 - DNA, 1760 bp, Homo sapiens
agcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggattaaggtgttt

SEQ ID NO: 14069 - DNA, 1168 bp, Homo sapiens
aagggagtggggcccgcctcttttctgacctaagggcaggagtgaggggccgggaggattacgggcggctccccctagacgcgcccccaggcgagctggagactggggcactccttgcttggtagaggggcggggcgcgcctagcggccacgcgcgcgggcgtcggagggggcgtgtctcgcgggcgcgcgcgggcgtcggagggggcgtgtcccgcgggcggtggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccggtaagtggggcgctgggctgggggctcggtcagggtgggggagggccgcccgggcggcggcagtggcgggacggggagggcgcggaaggacgcggagtcaggcgctgtccagggctgatttgcagatactgtggctccggcggcggcggccccgccgggcgggggctggcggccgagcaggatcgggttacacagcagccgcccgggggctgggggcgtttgttgggagcagcgcgtcgcctggaccccctccccactggaggctgggacgccgcctccgcgctggcccggacgctccaccgagtcaggtcctttgaggccaaggagcggagctgctcgggcccgtagtcctgaaacttcctctgcttcctcctcctgcccccgggtcccaccgcagccccgcgccggcccgcggccctcctggccccctcccccagggcctctccctgtcgccggaaggcgccgttgagtgcggccgggcgggttgagtcagccccggggcccgggcggttccgcctgcggggctggacagcgatttctgcgcttcagccgtccggcgccgctggcccccgcgtccggccacccgaccgctggagctggcggggc

SEQ ID NO: 14070 - DNA, 1587 bp, Homo sapiens
cagaccattgaactgttgaaggggggaaaagttgggaggacaataatttactactcatgttttgaatttttaaaataattttaacagtaaaaatgaaggttactttttatccccaccagaacaattaaaagtgcttgaggaggcaccacatgccagtggctgaatgatgaatgagttgtgcaaacaattggtagaattgttttatagggatagtagaaatttttttttggtgattgcagtagactattgggaattaacaactattttaaagatttgtttttaataggcgatgaagtttactgagttataaagatcatactggaaaatttttaagttatgaagaattacagcgatgtggttttaagccagtaacagtagtgtttaaactggtgctcttgttttgttttgtttttaattcagaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaagctttctagtccataagttcagttctcttttctgattgttacttgagtggttagttaagtagtgcttgagaaaaaggactctggttcaaatccaggttccattttgctatctttgtgaccttgcacaagttgtttaacctctttgttcagaaatttctccatggagtaacaatatctaggttgggaggattatgtgaagttacatgtaaagcacagaggaacagccaagagatcttaccgtggtcttacta

SEQ ID NO: 14071 - DNA, 3293 bp, Homo sapiens
cttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaaccatgatgcctttgtttattattggtatatccagaatgtaggaaagccaaatttatgttgctggaactgcaagtgtattaataggcttttgaagattatttctcaggctgggcgcagtggctcacgcctgtaatcccagcactttgggaggctgaggcaggtggatcatgaggtcaggatttcaaggccagcctggccgacatagtgaaaccacgt

SEQ ID NO: 14072 - DNA, 1194 bp, Homo sapiens
tgatattgccccactaaggagcctcttttaacatttttgtttattgagatggaatttcactcttgttgcccaggctggagtgcaatggtgccatctcggctcactgcaacctctgcctccagggttcaagcggttctcctatctcagcctcccaagtagctgggactacaggcgtgtgccatcacacccagctaatttttctgtttttagtagagacggtgtttctccatattggccaggctggtctcaaactcctgacctcaggtgatctgcccacatcagcttcccaaagtgctgggattacagatgtgagccaccatgccccacctctttgacatttttgtgtagttgctcccctgccatgtatgttcacgtactatacatatatctgtgctttagacataaaagagcaacaactttcactctgcccaaacaatttttgctcaccttccccacgcttttttttgcaatattcctcctgttgagaatatatgttgtagacctctacatgtttaaaataataccattttattcggcagtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtaagtgtgccaactatgactacaggctcaataggaaacatgtttataggactagtagattcttttgtttgttgaatataaattattttgcttttctttcttggtcaaaggtaaaactactgggtgccgggtgtggtggctcacacctgtaatcccagcactttgggaggccgaggtgggctggatcacctgaggtcaggagtttgagaccaacctggccaacatggcgaaaccccatctctattaaagatacaaaaattagctgggcatggtggtgggtgtctgtaatcccagctactctacttgggaggctgaggcaggagaatcgcttgtacctgggaggtggaggttgcagtgagctgagatcatgccactgcactccagcctgggcaaaaagagtgagactccgtctcaaaaaacaaaaaaaaaaacttactggggacttttgaattatgaacatgaaatttt

SEQ ID NO: 14073 - DNA, 1113 bp, Homo sapiens
atccacaatttctgtgggaggatgtgtacagagggcatccatagatactctctttttaatttaaaaaaatttttctcctgtacccactgatggcagagatattctttctcttgtaatatagaaatcagaagatgacaaaaaacatatccaaagtcactcgataaatgtctgtcatggaagaatctgctttcccagtgctgattccaatgttcttttccttcatagacttttttttttgttttctgtgtgggctgtagtattagagttcagaatagtttgtaatatttggaataagggtgtgattcatggtatagagactcctgtggccttctctctgacttggaactgattcatgtatgtggtttttaatctttgttggggattatgtgacattccgtgtctatttcctcacaggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtgagtacaactttgttcatgtagctagttttagaaagtaaaccaaatccacttaactaacttatttttatatgaatttaggtacgctctgttaggattccacagattggagacaaatttgctagtcgacatggtcaaaagggtacttgtggtattcagtatagacaagaggtaggtatctttgatctccctcatgcccaaaccagttttgttaaatattttttttttaatcaaaatttgctttaacttaagagctcaaagatgatacaggttgaactttttgattttattgttgaataagtatatgaacataccatgtttaaacagaatttgggacatacagtaattcagttgggagaactgaaatgtcagttctagtttagtatatgtatctttgagtcccttttaaaatttttctttgtaggatatgcctttcacctgtgaaggt

SEQ ID NO: 14074 - DNA, 1237 bp, Homo sapiens
gttgaagtgtatgggttttcctctgggccaagataggcatcttaaggtcagaaaatccctgcaattttaataatttatcctttaaatctaatggattgcaagaacatattgtttatgtgtagagtcagcaatcggtcattatccagggcaagacaggaatataacttcggagccctgaggaatgcaaagtttcggtgctctgtagcttctcaacgcggcttatgtaactaaaattttttaaaaatacttgtactatagaataatagtaatagcaagattctaagcatttcttccataccaagtactttactaagtgctctgcatacattagttcatgtacttatcatagcaaacctttgacttagatactatttttatgactattctatagatgaagaaaatagctagtttatggtagagctgggatgcagctgtaggtttattgactccagagtccatgctgttaactatgatactacactgctgctaaaaataaaataatagcaattaaacaaatgcaaggatgttcaataaagtgctcttttcaccccatgagaactctatttgttcttattctgaaatattacataacaaagtatataaatggatctctctcttactttttttttcctctctttccttgtctccctccccttggtattcttgttttgctgggactttgtcttagttcattcaggatgctataacaaaatactataaactgggtagcttataaacaataacaatttatttatcaccaccctggagggtgggaagtccaggataaaggcagattgagtgtctgctgagggcccacttctggctcatagacagttcattctttattttattttattttgttattcttatactttaagttttagggtacatgtgcacaatgtgcaggtttgttacatatgtatacatgtgccatgttggtgtgctgcacccattaactcatcatttagcattaggtatatctccaaatgctatccctcccctctccccccaccccacaacagtccctggagtgtgatgttccccttcctgtgtccatgtgttctcattgttcaattcccacctatgagtgagaacatgtggtgtttggttttttgtcctcgcgatagtttgctgagaatgatggtttccagtttcatccatgtccctacaaaggacatgaactcatcattttttatggctgcatagtattccatggtgtatatgtgccacattttct

SEQ ID NO: 14075 - DNA, 2282 bp, Homo sapiens
tacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaa

SEQ ID NO: 14076 - DNA, 1133 bp, Homo sapiens
aataagctcaagatagattatgatttttcttataggcaataatcttttcactgatctttacgtcattcatacaaagcaggtactctgtttttcttgaataaaatgaacttccctaatctttattcataatgattcagaatctttaagtgcggccctagttattataccatattacatcattactctatgtaattatctatgaagctatgtagttatttacccctgtattaagtgattttagactgttgttattttttgagttacagcatgtgctttcaaaatagggagactgtatggttgaattaatatttttttaaataactgttaacatgtatagagtaggttgaaagtttgaaagtataaaatatactaaaagtatacagacctgtaataagaaatttatattactatagtcccatagctgcttttactatccacagagaaatgcttgaaaacgtgaaagttgaatagatgcaattaaaatcacggatagttttaggctgtttatattatcagatcaccttcttttatctaggttgccttggagatgatcaaagtaactggtggctatccatttgaagcttacaaaaattgttttcttaacttagccattccaattgtagtatttacagagacaactgaagtaaggaaaactaaaatcaggtatgtatgaaagtctatttctcttgtataatgagaatgaaataaaatattttaccttttaaaagggaaaaatactagcttcacctcttttttcttctattgtgtatgtgtaaatttttgccatcacttcaagatcagctcaaacctcatcttcattaaatatttctgactaaagtagccaaagaacccttacagcactttatctgccacattatttggcattatggtttcatctgtgtctgccagatgaattagaaggtaccctggtgtctgactgtaggtcatgagatttagaagaattccacaagcttgagacaaagcagaacaattcctgggcctgtactttttagttttcagattggcaacaaccaaaaacttgaaaaaaaacctaccttaacaagggtgtgagaaagcagacactctcatacattactaatgagagtacaaaatactataatccacagtaaggg

SEQ ID NO: 14077 - DNA, 1213 bp, Homo sapiens
taacaatttagtttgaaagaaaatctggaacataatactcagtttgtaaaattgaagttggtagaattggaggaaaaatgtagagctagcctgtgccagaaaaacattgatgacatttagcataattggcagtatatatggataatagttgaaggtcatcactagttaatatctttggcctaaatcttactgaagggatcagatggaaaagtcattaaagttaagtggaaaactgcataaagagatttgaataatctgttgtagatgtctaatgaggcatcatcctttttctaaaccatgtcagcatattaccttctgtgaattaatttattattgcatttctttggattgttctctccgccgattataatacagagacttttctttttttatattttaaaattgtttatataaatttttttttcaaatcagggatccacttaacactatttgcctttttgacatacctaacacatttctttccttttctagcatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttcccca

SEQ ID NO: 14078 - DNA, 1272 bp, Homo sapiens
aaatgtagcttttcaattaatctatcccttactgaaatttaagagagcaaactatattcaagaagggatatcatgtatttgaagagagtcagtgatacacttgtgaaacttaggcagttaggagattgatgttagtgatcattatagcactattatgtaacaagtggcttgattagcctcattcttccaaaataggttgtcctgttgtagaaagtgaaaatagtttttccccagtaacatgactactcaaatgtttttacattttaatttgttgggttcttattaaaagaagcaggggaaagaatatttttctaaccaccatcgatttttcattttcagtgtatacatcttcatttttgcaacttttgcaattttttccccctcccccttaagtttacattttaaaaagcttatctgtggttttcttggtaagacctacatatacccaaggtggaaagtaaacatttgttttaaggaagtcctgtcatagtgtgctcaagatagttcctctgcccttaccttccctgtgaagcagaaggaagaaattttctgattagcaagatttggagtgtgaacatagaagatacctatctgaaagcttctctagcagtttacaattctatgatatcattagttatttcctagattatcatgtaatctgagaagaaaatttgaaaatgggataatacagtagtagcatcacttaaagtacatatttcatggaaagaattgaaacgagtggtaaggaaggtttaattataatgccataaaagaaaaatataaatttgatttactaaaatgcttgatgtttgaacagggtatttaaaggatccacgataccaggaagtggacaggtaagtcgggttcactcttgcctagttttgaattacattcttggaactagtttatgaattacctgaatttagtttcacaaatcttattcccaacagacgattttcaggagttcgccgagatgtgtttttaaatggggtaagcatttcattttatctatttaatgtggataaaatcaggctctgatttattttgcagttctgtgataatttttaattatattgacattatcatcttttattttagtcctacaatgattatgtgagggaatttcataacatgggaccaccaccaccttggcaaggaatggtttgtattattctatttttataagttacataacttaatttgcagttctagtatttcaggtgcttactcggaatatgattgttacagttactcattaaagagacttaaact

SEQ ID NO: 14079 - DNA, 2021 bp, Homo sapiens
ctagcactagactgccggtcgcaagcgccgggtacacacgcagttaaacctcaatggaacgcccccgggacttctccggggcgtaaagcgcagcgccctctattggccatcgggacctcgcctggaggtgccgtcaggattccgtcccccagccactcccaggcactcgagagtaagcgcattagcccgagaaagcgttctgtggaacggaacttccttatcctatcgtttccacacggaaagattttaattcaccggaatcgactggcgttaaagggcacagtgaaaaggaagttggtatcaacgtgatctcgactaagggaccgagcggaagtcctcaatcgtacgccacgcggagagcatgctgggggccggaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaata

SEQ ID NO: 14080 - DNA, 1545 bp, Homo sapiens
aaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatg

SEQ ID NO: 14081 - DNA, 1225 bp, Homo sapiens
gtatttagattgtatgaatgcattcttttataggatgtgaaaataaaacataaagagataaagtttcttttttttgtgggggggatggaatctcactctgtcacccaggctggagtgcagtggtgcgatttcagctcactgcaacctctgcctcctgggttcaagcaattctcctgtctcagcctcccaagtagctgggactacaggcacatgccatgatacccagctaatttttgtatttttattagagatggggttttaccatattggtcaggctggtctcaaactcctgacctcaggtaatccacccgccttggcctcccaaagttctgggattataggcgtgagccagtgtgcctggccaatgaagtatcttacaagctgtgagaaataaagaagttatgcccgcatggtaaatatgcaataaatgtcatttgttattttctctagagaagcgcataaagattaaaatagttattgaattctcagataacccagcaagttgtaatgattttttttaatgggtttgttcctttgttatgtaaatttttcatccctgttgggttttttcttcgtagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttatatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataattaacagcaaaaaaaaaaaaaaaaactggtggggagaattgtatgttttgggtgggcttcttggaccttacctattctggaaatacaagtatgtaggtgttgactgacttttgactgcataataattttctt

SEQ ID NO: 14082 - DNA, 1202 bp, Homo sapiens
ccaccgcctgaaaaaagagcagttcgattgcacccacttccccgggccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaagggcggagactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctactctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggtaggtttcgtgaggctgctgacgcccccacctcgcatcttcttgctttccgccggctggttgtgaagttgcgaggccc

SEQ ID NO: 14083 - DNA, 1096 bp, Homo sapiens
aagatgcaaataatgtttttgctatttattctgcctttctttatatcatgcataggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttggttttggttacttgaggagttttttaataatattgtgtgctgcaagaaagtgcttgttgattgaactgccgatggattggtttctgtgtggtataaattgtggcccatttatgaagtccccaaaagagttatgtttttaagtgccttggcaggctcacttctgaggtgcaaaacatagatatagaactgaacagggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaa

SEQ ID NO: 14084 - DNA, 1336 bp, Homo sapiens
ccttatacagtagtacactgtacttgtttttagtagtaagacctactttcccactatatgtagatagtttgttttcactgtgccagaatctcaggtgcctgcttagagtatttctttaatcacagtcactgggaagtaaggagatgtatatatgtgtatatatggtaacaaagcatagcagttctctaggggagaggcctggcattgcacatggtgttacatggctacaagtaaggaaaaaatcagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcagga

SEQ ID NO: 14085 - DNA, 1254 bp, Homo sapiens
ggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaatcctgactttgcattactgtttatttttgctataggcattcccacactaaacacattccaagggaaatattgatggcatatggaatatgttgaacatttaaaatttgttaggcactattttctgtaatgttcacaacaaccagtgtcttaacatcttagaaaactaaagctcagaaattgtacaagtcactgatttgg

SEQ ID NO: 14086 - DNA, 1196 bp, Homo sapiens
caggtttattcttaaagattattcagatagttcatggttgtaagctggtggtgtacatcctgttttttgtcttcacatacttgtgtcagtatgttattaaccataaagaagggagaaaaatgctttattttggacattttaaaaatcagttattaactttgttatgagtctaaagaaaatgccttagtggtctgggatatctttcaagagagctgcctaaaatgctcttactttatataatgtttttccagctccagtgacttttttagttgcaatggatttttacaataccatttgaagaagtgagatatgaatggtaacaataataagagctattatttagtggagggctactatgagccaggccatcttctaagcactttgtattatatattaactcgttaacttttcataaccaccatatgagggaagcatgaaaatgcattagagtctgttacccagaaggagaggatattactaagaatagagttcaacacagtaggtatagcaggaaaaatattcaggaaatataaagaattggctgactacagaaacccattgagcagaggaatgagagagatgaggaagattctgataaactatccaagtagggagaacttaaaaagctgtagatcatggtaagaaaggagtaaatcccataataataagaccaggagaagaaaattaaaagctttggtcaaagaagagatgtttagattttgagagtttggaaggagagaaagctgagattgatgaactggtccaaagcatgtggctagctcccgaagcatgttgacaatgacgtccatcaaaacttgtaagttagagtaatgtgagtctggtgaactgaaagtatcacctgcctcaatattgatatgattggaaagtggcacagagcatggtagagaagaacatcatgggaaagttgctaaaaccataagtaaaagtatataactgtcctggaggtcggcatatttagtgatgtggaagggcagaatgaagaataactgggcttcaatacaaggcagttcataaagcacgaaaacaagtgaggtatgctcccatctaacatggagagtaaaacaaacaaacaaaacaaacaaaccaacaaaaaaactagactgtcactaaagaacaaatctctgcaagaaatcagtgctcccaaaggaaaccaagtggttttcacttatgatgaa

SEQ ID NO: 14087 - DNA, 1915 bp, Homo sapiens
agtggtaccaaaggcaggtttggggctaaaattatgaaaggtattgtatattctactgggtagcagataataaatgaaagattttaagttgcaaagtgactgtcatatgattttatacattaaagtttactagtggtgtgaaaagaccatctaaaggttatttattaaaggtactataaataactctgagaattcacataaatggttgtatattttagtttagtgtatgtttaatatctttgatttatttttcttccacaaccgtgaatctataaatgctcaggtaatgattttttttttaaaggttgtaaatcagattctgtttgagggataagaggtaggaaaataatagaaaaaaggtttttatcatttttttccattagttcctagtatattgcaaattgaagagtacctccttagttttttaaaagttttattttaataaaatatatgctagatatatattttgtaaaatgcatgctctatattcataggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagat

SEQ ID NO: 14088 - DNA, 1154 bp, Homo sapiens
ttctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaa

SEQ ID NO: 14089 - DNA, 1186 bp, Homo sapiens
attgcagtgattgctcttattaatgtcttcctcctccaccagtcttgttagttccatgaggtcatggtggagtgtgtctatttttccttactttttgtcctcacggtttagctggtgactggcaatagtgaatgtcagtacatattttgaaagaacagcaagtaaacgggaaagggaggaagcaagaagcacttcgaggtgccagcgagcaccctggcgtccaagagcagcgcgcgggacccgctgagcccagggcccgggccgagctccgcccctttctccaggctccccgccaccggagggagagagggaggacccgtcacaggtaacgatgcgcccagtgagcgtcctttcctctggggccaaccagcgtctccgcgccgctgccgccaacctcgcgccgaactacgccctgagatttgggcgggtagcgattgggggaaaacaggcaacctaagagttattaccgttagcagcgaagactgcgactaacgtcaacgacggagactgcgtctgccttcgcttccgcctcgtagccccgggaaccggaaatccgtctgccccgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggtgacgccttctatggactcttccctgacaagcttccgtcaggttgggctggggcgggctgggcaggtggttaggcttggatttaagtttgaggttaacctgattttcaggataccttttccacctggaactgggttcttcttgaggagaacgtttttggcaaggcgataagccccacctttcctacctgcttcgtacctttaaagcaaaacccttcttgggaagtgattaggcttgcacagtggtctctgccagtgggcttattcgtcttttgctgccgaagtagactgaggcagccccgggcctgtactggggttttccgttcaggtgtgtgatgaaataatggaagtggagataatggaaataagcaagtggagaacccgaatacgatttca

SEQ ID NO: 14090 - DNA, 2461 bp, Homo sapiens
catctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattcttt

SEQ ID NO: 14091 - DNA, 1390 bp, Homo sapiens
acagtggttactatgaagctcaccctgtgacgtaagcatactatttgcaaggttaaatttggtctgaactatgtcagcaaggtggtttctgttcctagaattattgttgaaagtaaattcttgataaaaccacctattatgtcagtatttgagtacctattgtgtatatgcaagaaatttggaaagaatggttttatttaatacaaaaattgaacatggcttgcaccaaaacagtggttccttactgataatgtagagtgttgaagacaacacagagtaagcattttatttttataaaagataaggtttatagttagcactaaagtaaacattcttagtaattcagttttgaaatggtgggattaaagaactgctacttgagagtattattccttctgtcttatagctctttttggaattttgctttgaatactttgtagatctagaacaagttattggcatataactagttacacccattggattagagagaaattgaattttttcttacttgaactcctactaaaaagtgaactaaatattttattgtagtaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggttagatcaaagaactctttagacttacaacatcacatgttcaaatttggtgctgttaatgaagtatgacctttttctattatgttaaattgtttagtaaattattttatgtatatgaaagaagctgtggggtttgtttgttacctgagaaaatgttattgtttccctgccccgcaaaatacccctctaagagtgaaacttataacttaagatgaatccttgtctgtatgcattgtttagtaacttatatgaaattatttggatccatgtatagagctgtcagttgttctttcattctgtattaaattctctgagcacagatgcaccaggaatcatgcagtttcccaacttaaacaagttggtctataattaaaagaagagatacctgttgtttgtggtttaaatgggatcagtttcctttctacaccaattaaactatcttggaaagatgagtgacatccttagtgtatcatgtaagcctacctgaaacttcttttatctttcttcaaagtcaaaggttaaagtatatttgagtggtgataggaggagattctttgttcaatttgtgaatgtcagagtttccagctaatactctcttctttcctatccttccctctcccgttaacaccatcacacaccctatcttacccccaaagg

SEQ ID NO: 14092 - DNA, 1196 bp, Homo sapiens
tgcattttaagctcgtctacagcagcaacctgcagacacctattcagagagattactaaattccctccttcccattaataaaaaggaccagaatatcagtctacaaaagacactgcgttgctgcgaaccagctctcgcttgcgcgatcaggaagaagggcggcaaggctggagcctcgggaccggagaaaggcagcctgcttgtgacgtcaaatcagcggactcttatcttggctttaggccggttccggttccccggctttccgggcgcgagcgtgtgcgagcgcggcagcgtactgcgcgtgctccgcagagggacacgggaaggttgggtccggctctggaggagatgcgtgattggctgacgctgtgctcgggggttccctggccctttcggcaggggtaaaacaataagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggaggtgtgtacgggcgccgggaggggaggtcggtgtggtggtcggaaagggacattccattcgcgctccgcggcgcgaggcaatcgtccggtgtgtgagcccgggagccggaggtgtagcggcagagacattgttcttgccggctccctacggtgccgtgtgtgcgtgagagaagaccagtctttcctctaggtgaggggtgggaggccgcctgggaagggaggtgacccgcgagcgtcttgcgggcagagggctccgagtgcacaggtggggttgaggtttattggggatgaggtggcgaagtggggggggaggcacgcagcagctcccgaaggcgcgctgatggaagcttaatacaggaagtgtgggagcaggctttctggaggggatgttttagggtgggtagcccaccgttcctgtttccgaatcgttttcggctcttgtaccttgttccttcggagcggagaggccgtcgccaccccgcccgtggggggaggggaaaagaggttgtgtcgacggaggcagaagcgacgcagatgcgaaagtggcggcctc

SEQ ID NO: 14093 - DNA, 1590 bp, Homo sapiens
tgaggtcaggggttcgagaccagcctggccaacatggtgaaaccccatctctactaaaaatacaaaaattagcagggcgcttggtggcaggcacctgtaatcccagctactcgggaggctgagacaggataatcgcttgaacctggcaggcagaggttgcagtgagccgagatcgcaccattgcactccagcctgggtaacgagcaaaactccatctcagaaaaaaaaaaaattatcagtagtatatattgttaaatgttgaatgtgacatgaacagattttcacaatattaaatacgtctttttcctctaggttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtagtattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgatgaggcgacttttcttattaggggtacacaactataactgaatgttaaaaacaatcttctttaaaaccaatgattatgattccctaagattggagggggttagaagtacagaagtagaagaggttggaaaagggtttggacgtttttaaattcagcactggagttcttggcaatgatttcctgttgaagaagtg

SEQ ID NO: 14094 - DNA, 1168 bp, Homo sapiens
atgccctctatatttagagcacttactaggtactgtgttgctagtaaaatagtcaaagtggagtcttttttcctgtgactagcttgcagttttaagaaattaatacattaatatgttgtttcttaatttgttctagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttatataattctgtctggtgctttatttggcttttgaggaatgaccattttttgtccacataggtactaaattcataatcacaagtcaggaattttagtcttaagtcttatttttgcctcctagggatttttgtcagtgctgttatattttgattagggtatggcaagtaaaacttacttcagatatcatctagtattaagaat

SEQ ID NO: 14095 - DNA, 1204 bp, Homo sapiens
catacatagtcattttagaattatggcaataggcttaatgtgttttctcagctgtaactgttaaccacccctttaattgaagggtatatattacattgtgatatttctattttaaatgcttagttcatttcttgtaacattttgacttcttgattggtagtatagttttttaaaaaattgatcttgaaagtagggaaaggaaaaattagatcaatatattttgattttatatgtagcaattataaaataattttaaaaagaagttgcctttatatatacaaaagattcttcctttctatttttgttcttttttaattaggtgggtttggaggatttgggacaacatctacaactgcaggttctgcattcagcttttctgccccaactaacacaggcactactggtaagaggccatcttaagtcattcatagaagtaaatgaagtagaggtcagatttttttttttttttaacttacgaagttccaatttttcattcaaaggactctttggtggtactcagaacaaaggttttggatttggtactggttttggcacaacaacgggaactagtactggtttaggtactggtttgggaactggactgggatttggaggatttaatacacagcagcagcagcaaactagtaagtatgaggttttcagcttcaaatacaaaaccgtgatgatactagctgacattattgagtgcattcagaatactttagtggactttttataagaattattaatatattccaaaggattaggaatgttacttttcatgtttaaatatgatagcaactggggagaacactgattggcacagttaggattataaggtccctgtgtttaggatcattccatttaaatttttgttgttaaaaataacaaatagagaaactgcacaaaagtacagcttaatgaattatatataagtttacaaaggttaacacccttgtaatcactgcccatgtcaggagatggttcctggccagccagttcagaagcctaccacatttccctaccaattgcttccccatcagaggacctgcagtcttggcttttatggtgatcattttcttactttatattttgtcattcaagtatgtaaacagtatttggttttgcctgtcttaaatctccataggctcctcttttatctctcttttttatttattttttattttttgagacggagtcttgc

SEQ ID NO: 14096 - DNA, 3720 bp, Homo sapiens
aagttgaatagagtctaagttttataatccagatcaacacagagaagggtactgctctggtattgagggtgggagtggtcagagaaggcctcctggaaaggttaggcctgctgaatcttcaagaacaagcagcagcccaagaggggaggtgagtgagatgagccaccttcctataggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaattgctctagaagtcatatgtcattggatgtcctgttgtttatggagtttccctggaaagatgttccttgacagatgcagccctgagtcacacacttgggccatgtctgatttcagcttcgctgtagtggacagttacaatcagcctgacaagtttcactccaagcagtcccacattctgcttttctgtcttaagtctttctcaagagccctcaaagcaccataggagtatcagggagttaataacccaaggcaaccctcaactaaatggggcaggagtcagtcagctgatagatgtttcaatcctcagaggaccagttctcaggcttattccacatgggtcctcaattagggttgcccacagtggtaactactttctatcagtgtttctttattccctgtcttaatcgcccagcccttcaatgctg

SEQ ID NO: 14097 - DNA, 1131 bp, Homo sapiens
agtagaagctgtcactattggctctgtagatttggctttacccttaactttcgctttttgacaacaaaaatatctcctgatgttgattcagcatttatttttactactttgaaagcagttggggctgaattttgtattaaaaaagtgatgatttagtagcactggctggagctatatactgtgcaggaagattctgtgcaaacctctgcatagttctgccaatgcaccgccatgctggcctgtagcatcccttattattccatagctgtgtctttttgagcacagaaaaacagaaaacaccaccaccaacagacaaaccaaacctcgtgtgatttgatatgattggcaatatctctaaaatcaatgtgagattagaatgaaatcccaatactcatttgtccagtgatccaaaccaaaaagtgcattcatagatggtgaaagggaaaaccagtgctactacgtaaaaataaaagaaaaagaaaaaatctttaatacatctcagatgtcaatatttattctggatattttaaaaggcttttctttatagtgttttttacagctgtttatatcaactcagctgctacttcaatggttttccctttcactctctatttatctttttgattgattaatataaatgtttttactctaaaaagtgaaaggtaaaagcagacctatagcagctgagtcagtactgacaactacaaaacaaatgttcctgcagggggctggaggaacttcttatacttaatagacagatggaaagataagacttggctcgtttctttttctttctttttttaatttggtctcatgtcaagtttgatgttatgaaatgattatccagaagttttttttttttaagtgaaagcagacaaaagagaaaatcttaatttaagcttttaaagcatatatacaaattattttctttgctcaaggatagaaatggtttatgccaggctaggagtagaaaacatttattttaatcatatgattaattcaaattggaaatgttcttgttaaatttatagctcaaaagacaggtggagaataaattgtttcagctttattaatactgttcttgtggaataaagtattagaattgaaaggaacatgagagatcgtctagaa

SEQ ID NO: 14098 - DNA, 1173 bp, Homo sapiens
tctactaaaaaaaaataaaaaattagccaggcgtggtggcacatgcctgtaatcccagctacttgggaggctgaggcaggagaatctcttgtatccgggaggcagaggttgcagtgagctgagattgcaccactgcactccagcctggcgacagagcaagactgcatctcaaagaaaaaaaaaaaaaagagtcacatagatttcttttactgtaacaacataacatccatgaggactgtgtatgcaatatacacagttccctgagccaacacaacctgttgaggatgttgtcacagagaatctggagcagagtggatctgaagtgagcttaaattggacagagctggactatgaggaagtgactggtgacacaaatgagtccactcctggctcctttaaactactgtgaatgttctggtcttttcaggaatggcgttcccatactagccggctgattgtgataaacaaacgtcaaacatgaccattcgtcattccgcatagtggagatgagctctggtctgcagcaggaggttgttaaatttgacatattcaaaatgaattgcacggcctggctgctcttgaactctggcttgctgggagtagcctatgatggaaggaaattccactctgtggtggtgttttggggaggttgcatggtggggagaggaaaacataaagctgggataagaacagtgctttcctaagaaaaaaggaggctacttttgaacgaatgcatctatgatgccagatctagtgggaggcttctcttcttttgaaagatgattctgtgccccaccccattcctatcccacatttgcctcaatttcatttccttagatttcacattatagagatataaataactctggaattcaagtggaacattctagagagacagacattctagttaaaacaggaacaatctttcaataaaattagtatcacctttgaaatgcaatgatactttgaggatgcttcagactttgttggtgtttggaatgattactactgctggtagaaaataatgccactgtgaattcagaattctgtgtgtgtggggaggggggcatgctccctttctctcttctttctgtgcctaaaaataacctgcaaatcttgttcaaattcttttgcaaggaaatttataaattgtctgtgtattctataattatt

SEQ ID NO: 14099 - DNA, 1200 bp, Homo sapiens
tctctacaataagaaaactcctttcttcctagtgttgttgataaaattaaatgaagtggtatgtaaaagtggccctgcacagttatagacagcatggagtggtacaaatacatctggctttgggccagatgttctggcatttgaatctagaccctgctacctctctttgggaggtcagcttgctcaccaagctcctgcgtctgcaaagcaagagtcatgacatctagttggcagagttattatgaagggtaaagacaatatttgttttcaagctcctccctctgtgctctgtgctgagtaggcactcagcagtcagcgttgtcatcagtattatggtcaatgttgtcagaaatcttgtcttcgtcaggaatgtaaggtgaatccagtaaaggatcttcagatggtcttgagaccccagagatttcaggagtgatggtaataacatcttggaagcatcactgcagatatttcagtgacatcattgctaatcccacttccgccatttcccccctctcttgtagttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcaggtatgaaggcatctagcaatcaggtgtctcccagacagtggcgagagtggcatggtggtacatcacagaaatgcttgctggattgagatggtgatgatggaaggatctggtgggtgaagattaatacatatgttgtcaggcattgtgataattgctttatttgcattatctcaactaacttacctagttgatgtcattattatccacattttacagatgaggaaacaaaggcactgaaagtgtaaacaaactgcccaaggtcctccaagtagtaaacaatggtgtggtgttgagctcttgccatctgggtcctgagcccaggtttctgccagttctcttgcagaggtgcagagcctggtcgatatatttacaaaggtgcggctgctgattacagtttgccccattcatttttgccaaacacctttaacttccggaggctcttcctttgtcaagcacttttactattagctttcagtggttcggtaaaattctaacaacaaagaatcagga

SEQ ID NO: 14100 - DNA, 1067 bp, Homo sapiens
taaattacatacaaatggaaactaaccatatgtctttaattcagtattaaattttgctttggcttgtcatgtagagtagccttctcaaatttttggttttaatttctgtcaattccataatcattgcatgagcattcaccatcactgaatgctggtgctgtcgctcctaattttcctttctttttaatttattattatttctaacttttttgttttgttttttaacttgcagtgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccac

SEQ ID NO: 14101 - DNA, 1888 bp, Homo sapiens
agccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatg

SEQ ID NO: 14102 - DNA, 2236 bp, Homo sapiens
tcaagttccaaagataattatattagaaatacagatttggacctaatttctaagatgatgttgatggatgggtagctggataaataaatgagttggaggtagatgtggggagagaaaagactcagcggggacggaaagcacagggaggaaaaatggccaccagagataacagagcagcctatgttaattaatgatcaactgtgtgtggctttttttttttcctggcccagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaagaaatccaaaagatccaaactttttttaaacttaaaaaatctctttgtagtatgtcagttgcactttttttctgccataatgtaacgtagcttgccccgtcaaaaattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtccttaacttttgtttttgtgacttttttctggttgtgaagaggtacaggttcctgattggctaggcactgctatttcaactagagaaaacaatagaaagaccaagaatacacttactgaaaataaaacatgaagaggatctgaatgtgatcgagggatataggttttagacataagaatttttctttcgtgatattttttcactggtgcactgtgaatcctccaaatagtaaatttacatcttaatgtgactgcttgtgagagtaggctcagacccctatctttaaaatgtcatttttagccattttgtaatgttcagatttagcagaacaagagtattttcaggtcatcatctgatttgtaaaaaattcttgtggtagggttgacttacctgttttatgaccttaaaatccaattaaatgggaagcatttactcacatgtcagtaaagggagtgggagggaagatagcaaaggattggcttcacagatagacattttaaaaat

SEQ ID NO: 14103 - DNA, 1312 bp, Homo sapiens
acccccgtctctactaaaaatacaaaaaaaaattagctgggcgtggtggcgggcgttgtagtagcagctacttgggaggctgaggcaggagaatggcatgaacccaggaggcggagcttgcactgagctgacatcgtgccactgcactgcagcctgggcgacaggccaagactccgtctcaaaaaaaaaaaaaaaaaaaaagttagctctagacacacttgatcttgcaagtgtactttccttcctttcattactgctctaaagctttttaataaactttctttcctgttcttaaagttagctctgatctaaaaagtaatgagtggcagtcacattaattgaattccatagtattttgtgtatacctgtctcatctgcatatctaggtttttaaaacagttacaaaaagttaaattgtttttgaaaaatcactaaagttgctttttccctcttcaaaattttaggctcatccaaaatacttgagttgtattgcaatcagctgttttttcctagctgccaagactgttgaggaagatgaggtaataaatcctttcaagataatgtttcttccgtgaaaatttctctccacatttattaacttgcttcgtttgctaaaacaaaaatcataaatgagtttcttttctgtccttttctccctgtccctgttcccctttgctttggatagagaattccagtactaaaggtattggcaagagacagtttctgtggatgttcctcatctgaaattttgagaatggagagaattattctggataagttgaattgggatcttcacacagccacaccattggattttcttcatattgtaaatatacctgaagtcttttagtttcttatttgagtgtgtagttttcagtaaattaaaaaatagattgcctactcatttattttgtactggaaataggaaaaagaaaacttgatatccaaggaaaaattataaattagtatatatgtcatatcactgaagcttaattcgcagacttagaaattgaataggttaggctgggcgcggtggctcacgcctgtaatcccagcactttgagaggctgaggcaggcggatcacttgaggtcaggaatttgagaccagcctggccaacatggtgaaaccctgtctctactaaaaatacaaaaattagccgggcatggtggcaggcgcctgtaatcgcagctactcaggatgctgaggcaggcaggagaattgcttgaatccaggaggcggatgttgcagtgagttgagatcatgctactgcactccagcctgggcaacagagtgagactctgtctcaaaaa

SEQ ID NO: 14104 - DNA, 1230 bp, Homo sapiens
atatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagt

SEQ ID NO: 14105 - DNA, 1087 bp, Homo sapiens
caggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttttttggtgtcttaaagttatatattaaatcacagagaagcaagggagaaagttgaaagatatctaaggctcatatcacttgattctatggtagattatattagaattgaggatgtggcacattaaaactggaacatgggcaaatatagtgttccattttaaaattctaagtttatattgttaaatgggtgaaaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggca

SEQ ID NO: 14106 - DNA, 1273 bp, Homo sapiens
ataaaataaaattagctgggtgtgataacatgtgcctgtagtcccagctactggggagtctgaggagggaggaccacttcatcctaggatttcaagcttgcaatgagctatgattgtaccactgtcctccagcctaggtgacagagtgagaccttgtctaaaaacaacaacaacaaaaaagatattgataaggaaatagaaacttcaaaaatggcacagtgcaagagttatttgctttgttaagcaagataaacacagacacattttctcaggaagggagctcataatggttaagaccagatgggaaggatagttatttattaagatgagtatgtagtaagacacaaaaaaacatgttttcccttccgtaacttttgggaataaatgccaatataagacagatttatatgagaatgtgtaaaatggaataagttattgatatttactctgaactctaaattaagcctcatataggcttaattttgtgttttttcaattttaggaactctgccagcatctgtgtctctgcctgtgattgattttgcaaactattgttgagatgattagtgatttgtattttgggtgagatttcattgagttagcagtctgattcattatgaagcactctggtgcttgtaggatttttagtctgaatcctaaatgaaataacattaattgtgccaaactacagactgagataaaatgaccttacacttagggtgataagagagaaactgtaatttaacactataggacttacatctttacatacgctatagaggcatcgttttttgtaagctactttagatgaccagtatttacagaagcttagttctagcttttaccagtttgccctgatttggccagcttgttttttcagggggagttatgctactttattttcctagtgctacatataaaacttgagatttggggttaacaatagtatatttgtatgtatttcatatgtagttttaaaatatacctttcattgaaatagcatgttacgtagatttatttgcagttttggaaactctaaatttaaatttttctgtgcaaagcagacctagcgttacatataatattgcttataaattaaaaaactaaaatacaaaaaccccctaaaatacattaaatattttttatttttaatgttttttaaaattttactttaagttctgggatacatgtacagaacatgcaggtttgttacataggtatgtatgtcccatagtggtttgttgcacctatcaacccgtcatctaggttttaa

SEQ ID NO: 14107 - DNA, 1348 bp, Homo sapiens
ataggattcattttacttagcaccagcttaatttccttaggaagggctcatgtccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgat

SEQ ID NO: 14108 - DNA, 1202 bp, Homo sapiens
gcgttatttaaaacaaaggcgaccacaatgaactcctctctccccaccccctaacccctgcgcacgcacacgcacaatgaagcgaaacctcattggctgggatcagtgacgcacttctgaaagccgcagtttggcaccatcttttccatctcctgctccttccgccttcccgccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaaggtattctgtcttccctgacccagtacccccttctcctaaatccctgcatcctgccttggcctgcccaattccatcctgtcttaccccattctggccctgcgagattttacggtaaaaaccacctggtgaccttagggagaagttagagtgagttgagggagactcattacacgctattggaagttaaat

SEQ ID NO: 14109 - DNA, 1168 bp, Homo sapiens
gaaaaaccgcaaaaaccagggcactgtaaattggtctgttgatgacattgtcaaaggcacaaatagcaacaatatggaaagtcagctccaagctactcaagctgccatgaaactactttctagagaaaaacagccccccataggcaacataatctgggctggtttgattccaaaatttgtgtccttcttgggcagaactgattgtagtcccattcagtttgaatctgcttgggcactcgctaacattgcttctgggacatcagaataaaccaaggctgtggtagatggaggtgccatcccagcattcatttctctgttagcatctccccatgctcacatcagtgaacaagctgtatgggctctaggaaacattgcaggtgatggtttagttttccgagacttggttattaagtatggtgcagttgacccactcttggctcttcttgcagttcccgatatgtcatctttagtatgtggttacttatgtcatcttacctggacactttcaatcctctgctgctacaagaatcctgcaccccagttagatgctgttgagcaaattctttctaccttagtttggctcctgcatcatgatgatccagaagtattagcagatagctgttgggctatttcctaccttactgatggtccaaataaacgaactgacatgttcttgaaaataggagttttgccccaacttgtgaagcttctaggagcttctgaattgccaactgtgactcctgcactaagacccatagggaatattgtcactggtacagatgaagagactcaggttgtgatcgatgcaggagctcttgctgtctttcccaacctgctcatcaactccaaaactaactttcagaaggaaggtacatggacaatgtcaaacatcacagctgaccctcaggatgagatacagcaagttgtgaatcatggattagtcccgttcctcacaatgttctctctaaggcagattttaaagacacaaaaggaagctgtatggggccatgaccaactataccagtggtggaacagttgaacaggctgtatacctcattcattgtggcctaataaaaccattgatgaatctcttaacttcaaaagataccaaggttattctggttatcctggatgccatttcgaacatctttcaggctgctgagaaact

SEQ ID NO: 14110 - DNA, 1691 bp, Homo sapiens
cacctggctaacttttgtatttttagtagagacggggtttcaccatatgaccagcctggtctcaaactcctgagctcaggtgatccgtccacctcagcctcccaaagtgctgggattacaggtgtgagcaattgcacccggcctaatttttgaaattttttgtagagatggggtcttactgtgttgctcaggctggtctccaactcctgtgctcaagtgatctgcctgcctcggcctcctgaagtgctgggattacaggcgtgagccactgtgcccagcctaagatacctacttttgatagggttgagaagggtatatcctttctttaatactagccatattcaaactgttactaggcatagttaggagtcgcctgaaaatttccatgggtaaaatgattctagcaagataaatattcagttgtgcaaatggagtccgcttgtcctgttagttggtaacagttgcttttaatctggtaaattgggtaagggttgattataagctggttggcatttcaaagaggcttgtaggcatctatatcagaatcacttagaattgtttgggagtgttgcctgggattctgtatttcacatacaccatgtgattttttttttttttttttttttttttgagacggagtctcactctgttgcccacactggagtgcagtggcacgatctcagctcactgcaatctctgcctcccgggttcaagtgattctcctgcctcagcctcccaagtagttgggattacaggctcctaccaccatgcctggctaatttttgtatttttagtagagacagggtttcaccatgttggccaggctggtcttgaactcctgacctcaggtgatccgcctgcctcggcctccctgtgtgctgggattacaggcgtgagtcaccgcccctggcctccaagtgatcttaattgcatactaatgtgttaaggactttaatgtgttaactctttaagatagagttaaacacactgtttcctaagggtttgtttttacatcttctgtaaaaacaaaggtatatgttttactaaaccagcattttagttgtggaccctaagtctaccttgaaaaaaaaaatgatatgatttttaacattctaatgagtacaagatgacagtgaacaacagtaatgtaccaagtcagggaaagtaggtggtgggggtggctacaggctgggaacatggtgagttgcttggtattgttttaaaattctctacagccaatacactccccttattgtctgtatcttgcctctgccctgatcttagccatccattgcattattatgaattggtaatcaacaactctgatagaaattgacttgctattttctctaattgggctggttatatattgccctattgtccttagcgccttttcgattctcaagaaggttgcataattccagcagccttccatgtaaatggcagtagtatagagtagctgagataaagaatagtctccaggggactgactatataatataggaagttgaagcagtagggtagttcctaaatgttaataaatttcccccagtaagccctgtaaaggcagggaattggagcggggggtggggggtagggggcaggtgttctcccaagggcaaggagaaaggaccttacaaaattattgtattaaagtctgaaatgctttataggatttagagcctaagtag

SEQ ID NO: 14111 - DNA, 1284 bp, Homo sapiens
gtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccg

SEQ ID NO: 14112 - DNA, 2075 bp, Homo sapiens
tcactttctgcattttaaaggcttaaatactttattgctggttaactgaggttctactgtaaacgaatcatctaagttaattagtggattgtacttcaatggataattttcactaaattgtttatattgcacattacttttgtcttaaggactcttagcacatcaaaaaaattggctcacaacttaattgtgagatgtagaattttccattttatgtgctaagagttttgttaatgagagaactgttaaaatagaaaaggagcttcagcatagacaccaatgctggttgctgagatcagtggggaactgcatagcattttaacaagtttaatgaacatttggaagagaaatttgaagctaagattctggtttttttgctgttaactttttaatctaaggaaaacttttatgtacagtatttttactttgggtatatgtttatcttttagcaagttgaaagacttaatttgctgcttgctcactattttgtaattatttgggagcagcagtaataagccagctttttggaataggatgttcctgatgtgtggttatgtaggaagaatgatgttttaatatactgcccagtaaactggtgcagtttggaaaaggtgtgttattgatgtggataatatttaaggcaattttttttaagcattttaatactgctttttgtctttacaggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtagtgtgttacgtgttctgatcagttaataatataaaatattaacatatggatagtttgatacaatgagtttgcctatttgtggttccccattttgatagtataggaaggaagaatagttcttgccccaatacgttttatgaagatagaggtaggttcaggaattatttcctgaataatttgtgttccaggctctgctaaattttgaaattaactttaaagatactatagacttaaagatgcctagttaaaaggatgtgttttagcaattcacagaagtccatattttgaaattttgttaggcaagcaacttttaactgaatcattattttgatcctgggctaaagggaagtagcagttatgtttgtatatagtgctaaagggaagtagcagtcatgtttgtatatattgaaggtaatggttatctagtaattggttaaatttgtgtatgtcctaccattcttacctttagatttaaacagtatatgttagttgatgttacatcaccaccatgacttgacagtttaatcttgagcaagtcaacatatgcttggcattatctgtatttatagttatttttaagtaagttaatagtctctgaacttcagttaagatatatattttttaaatgaaaacttcaatttccttaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtatgttataaatgttttgacccagtttatgtcaaaattagtgtgaatgtgattgtcccattatggactcagagtcacttggcttttcaaagctgttagggtagattatgtgatctgttttggaataaggatattgtaaatacttcattagcaggtctttgaaggttggataatgtgtttttctcattgagcacctactctatgcagagtattgctggggtagagtatacaaagatgaaatagacaaacattcttaaatacagacaattaagaggaagaaatctagattagaaggagacttttgttgaaaataggaaaggaattaagaatagggtgtagtgccttatcagttgaaatgcatgtgtaagtgcaaatttaatgagactaatcattatagactcattagtgag

SEQ ID NO: 14113 - DNA, 1130 bp, Homo sapiens
aacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctata

SEQ ID NO: 14114 - DNA, 1205 bp, Homo sapiens
tcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaa

SEQ ID NO: 14115 - DNA, 1146 bp, Homo sapiens
tttgcatttttcgtagagacagggtttcaccatgttggccaggctggtcttgaactcctgacctctgctgatctgcccgtctcagcctcccaaactgctgggattacagacgtgagccaccatgcccagccataactgcatttttataagtaatttatactagacttagctaacattgataaatctattccaaatgtgcctttagggtttttttgttcaaatgttgttcccatttattgtttttctaatttaattaataaaaattagttgtacagttagataatagttttgtaaaatcatttattgtatacaatttttcattcccattcatttaacaaatgcatatttactgagcatttagagtgattttgtttctctatgctattcattggttatgaagcttaatccatgcctctgaaaatattatttagctgctcacagcctcatatacagattgccttgggtataatcttattttattttcctcttacttacagatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggtagtatctttgaaacaaaaggcacttaatttttagtgttgtctttcaccctacttatcatcaagttataatctataagttcattttttctatacattcaagaacttcttttgctggataattatatgcatttattgctatctttgaagaagcaaagtttgagatgataggataggaaaatggggttgcagctgttgtaaaatcatggttgtgatttgtgagtttattgggggaaataggtggcaggaggattgaaaacagctctagggtttacctctttttctgtgtgctcctctgtctgcttccagtggctctgcctgccatgagcaaagaaagaagcaatgtgggtaaaggaataggaggcatccccaatgccagtagagaatctttatggttaaaggaaaatgaaagtgagaggtaaatggaatcccatgtagcagaggtccccaacccccaggccataaaccagtacccttctgtggcctcttaggaacctggactca

SEQ ID NO: 14116 - DNA, 1176 bp, Homo sapiens
gcactttaaaaaatcttagtattctttttcctggctaaagatactttctacaaaaaaatattcaatttaactatacttgttgaccacattaattcaggtgttttggttacaaagtggccataccattttctgagttttgttgtttgttttttgttggcctaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaaggtaataggaagtgttaaagttttctattataatgcctgaaaaaagtatgtgttgtgtaatattttgaaatgacttcactgattaacaatgctggttaattggacaattgtgatcaaaaatttttttggatatgactggaaaaaaatgaaactttgtgtatggtcggatgcttatgttattattatcttttttagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcagtaggtggattttgtttttatggtccataggcacaaaggactttttataccaaagtgttattatagagtcactctgatggaagcaatcagggtttaagttgggatttgagatgtacttgtgggtatttcatcattcaaaatggtttctctgaaaaattggaacctactcttttttttcccttttttaaaaatcatggtaaaatatacataaaattgatcattttgttcatttttaaatatacagttcaatggcattaagtacatttacattgttgttgtgtagccaacactttatattcctcccctcctccatttttttgtttgtttgtttgtttttttgagacagtctcactctgttgtacaggctggagtgcagtggcacaaccttggctcactgcaacctccgcctccttggttcaagcgattctcctgcctcagcctcctgggtagctgggattacaagcacgtgccaccacacctggctggtttttgtatttttagtaga

SEQ ID NO: 14117 - DNA, 1048 bp, Homo sapiens
aggactcaaaagtttgcagatacaggcattcacttgccattttcttaaggtagagttgaaagtactgctgccagttcatcatctgaaatgagggctgttttctttcctgtttaattggattgcaactatttgcctttcctaaagatgaaatagtgtgcttcctacattattctgacaacattcctttaattgttaatttcagatgaatttctgaaaactgcttttatcagaacagatttacttaaatgaaggcaatagccgcaaggggtcactgctctagatatttacttctgcataggaaataagtaatcctttatagatggaatttttttttcttagttgtatttttgtatctttacatttgtttataacttatctatactttttttgttgttgtgattattttactgttgacatggaagttctcaatctgatcatttggttatatcattgcttcttctagtaacttcatatccagtgattaaaccttttcactgctgttcacataatgaaccgttgtgattattgaatacttaaatgaggatatgtaagctgtattaaagatagtgttatttgcaaaggcattgactattgcacaaaaaattttaaaagaaaatatctcttttcaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttccca

SEQ ID NO: 14118 - DNA, 3220 bp, Homo sapiens
ttgaacttacagagcgtacattcatgatttaggaggattttagttaaagaaattctagtcttcgtgtagactattatcttttagttaaccacataaccttgcctaggtaataagtaacgtgttttatgttaaatttcctgaacaatattcttacaatatgtgaataaaaccaaatttaactttttaaagccctttttaggatgtgcttgtgctcactgtgtaaattgtgatgctcatcctgctggtgaattgtgaaagtgtcagtagagatttccagatgaaagaatgttatccacttttgttgttatttaacaccaccatcatctttctctttcaaaaatcatttcagattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatca

SEQ ID NO: 14119 - DNA, 1154 bp, Homo sapiens
taggacgtagctcattggagatttgaatgtattttacaatatgttaatatttaaatctttatttccttgtgtgaatcagcagttttcaagtctgtcaatgagaggaaaaaaatctgggtagaaataagatcagatacatcaaagattacaaattttattagagggcgttggaaaggagtttcatgtgattatgtgacttagtgttgcctgagtgcaagatacttgtggattgagacgagagtaagaatgtttgcttctagttttgtgttcccatatgacttatattatagattcttgcaggttgaggatgtgttaacatgatttaacccagataagcttcaggaatattcttcattcaattatatatcaatttaaaaattgtcattttgccatttgcattttttttgaatttttttcttacatcttttgaaacctagtaacttgttcatttttcaacttttattacagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtg

SEQ ID NO: 14120 - DNA, 1407 bp, Homo sapiens
atagagtctcactctctcacccaggctaggagggtgcagtagggtgatcatggcttattgcagccttgacctcttggcctcaagcaatcctcccacctcagcctcttgagtagctgggactacaggcatgtgccttcgtgcctagctaatttttcattttttatatttgtattttttgtatttgctgttttctcctccgtgttaacatgtttatttgttatgacccaaagtccagactaggtattaatacaactttgtattcctctcttgcagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaagttgggccttactgttctttattgtgacctttagtcactgccaaaaactgtaatttaggaaaccaattctgtttttttatgttttaggagaatttaaataaccaaatagaagtatttagctattatagccacatgtaccactgtttaccaaccctgacttttatttgggagatttggtctctgtgtgcagtcacagtgaccagaacagacaagtgggcagtcaccagagactaccttgattttctgtctatatcttttttatcttatcccattatagtttataggatagtgatatttaaatgtttactgttttttcctttacctgccctcaccttcacaatgttctcaacacagtaaccagagtaattctcttaaaacctgagtaaggtcatgtcattcctctccccagaaccctccaggatctccctaggtcactcagtacaaaacgaaagtcctaccacctgccaggccctccatgacttggcttcatgtctgacttctcacactcacacctgtagccccactggcctcactcttccttaaacaggctgggcagactcctaccccagggcctttgcatttactgttcacttt

SEQ ID NO: 14121 - DNA, 1207 bp, Homo sapiens
gtaatcccagcactttgggaggctgaggtgggcagatcacctgaggccaggagttcaggaccagcctggccaatatggtgaaaccccgtttctactacaaatacaaaaaaattatccgggtgtggcggtgcatgcctgtaattccagttactaaggaggctgaggcaagataatcgattgagcctgggtggcggaggttgcagtgaggcgagagagcaccactgtactccagcctgggtgacacagggagactccatctcaaaaaaaaaaattgcaaactttaaatattgacattttttatgaataagaaagctttttattttacaggtctttgtgggaagaaacagaaagaaatcacaaaagcaattaagagagctcaaataatgggtaagaaagaatacctcaacaactgaattgagctagctgaaattttgctcattatgttttgtcaagaactttaattatctctttacagggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctaccctcaaaccagtagtgtcttttacatgaagagatgatttacacctaatagacattgaatatgatagacatacatgtatatatgtatcagttctgagttccactggcctatcccaaatacactggattaccaggcttgtactgtattcaaaatgatagatttgctaaatttcatgcaaaggactctaaactaggggagagattactgtttgtgttgtgttatagttgtgtaataattaaggct

SEQ ID NO: 14122 - DNA, 1173 bp, Homo sapiens
ttcaattgacttacattgctcttgtgttttgtgtttgtgcattctttctccctctctgctgtaacccttgacactaacattgcacattaaagtgagctattatcaagagctattttaattctgtaaagattcctactctacacttaaaggaatggtttgttttaaattggaggtatgtgcttcacttatccctattaaaataacacgaacttgtcttctttgccttttatcattaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtg

SEQ ID NO: 14123 - DNA, 1152 bp, Homo sapiens
tgggttccactgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaa

SEQ ID NO: 14124 - DNA, 1119 bp, Homo sapiens
attttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccat

SEQ ID NO: 14125 - DNA, 1077 bp, Homo sapiens
acagctttccttttagtccttgttcagccacacaacacaaaccagtatggcctttggcattttactgcaagctttccattcgattattaatgtttccggtgcccatgatcaagcatggagaagacctataattaattgacttttcctttcctttaggtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttc

SEQ ID NO: 14126 - DNA, 1535 bp, Homo sapiens
tagctgggactagaggcgcctgccaccacgcccagctaatttttttctgttttttagtagagacggggtttcaccatgttagccaggatggtcttgatctcctgacctcgtgatccgcctgcctcggcctcccaaagtgctgggattacaggcgtgagccaccgtggctggccaggatctgcatttagaataatccttagatatggttatagacagactcaggtcatgtggatgcataattttgtataatgcatttctcttgtttaaacacagcctaaaatttgggtaattatctttgttatccatctttccctgtagctatccaaatcaacattttagttttcttctaatataaaaattacatccttactataattttataaaattataattataaaattataattactttttttattctgttactaaagactttagaaataaattgagcagaataagaaatatctatttattgtgtagcttaatctgcagggaattcatgactctaaaagtgttagcaaattaacttcttttttttttttttttttttttctgagacagagtctcgctctgttgcccaggctggagtgcagtggcgcgatcttggctcactgcaagccctgcctcctgggatcatgccattctcctgcctcagcctcccgagtagctgggactacaggtacccgccaccaaggccggctaattttttgtattttttagtagagacggggtttcactgtgttagccaggatggtctcgatctcctgaccttgtgatccacccgccttggcctcccaaagtgctgggattacaggcatgagccaccgcgcccggccgcagattaacttcttgaacattgtagaaatttatagtggaaaagttaatatataattttatttgtgaacttctgttttttcttaatgtttttctctctgatcatttcagcctattgctgtggaagttttctctggagatggacggaattacctccttgcttttcagaaaggaatcagaaacaaagtctatcaaaggtcttgtttattcggaacactttgtatactattatgggaagatatgggagggggaatcttttctcagttttgctggtttttaaaaatctagatcaatgagccaacatctttgaagaaaataatttatattatttttgccaccctcttgaaacaattattcttctgacttttaaaatggtgcaattctattgtgacataccatttttccttctggtaacttatagtagagatcatcaaaaactacttttatcactaagtcctgtgtctctaaatacaaaggatgatgaaactgtagctttaaaaataaaactttagtttctttttttcttcttctttttttttttttttgagacggagtctcgttctgtcgcccaggctagagtacagtggcatgatctcagctcactgcaaactccgcctcccgggttcacgccattctcctgcctcagcctcccgagtagctggaactgcaggcacccgccaccatccccggcttattttttg

SEQ ID NO: 14127 - DNA, 1129 bp, Homo sapiens
gccgggtgcggtggctcacgcctgtaatcctaacacttgggaggctgaggcaggtggatcacctgaggtcaggagtttgagaccagcctagccaacatggtgaaaccctgtctctactaaaaatacaaaagttaactgggcgtggtggtgggcgcctgttatcccagttacttgggaggctgtggcaggagaatcacttgaacctgcaaggcagaggttgcaatgaggcgagatcacaccattgcactccagcctggacaacaagagcgaaactccgtctcaaaaaaaaaaaaaattaaaaaggtatgcttcatgtgaaaagaattgtcatctttctcactaagaatgacctgactgtgtggatttctttgttgattttagcatgctttggatcttcaacttgccgtggcaaatattttacaatccctggtgcacacagaaaggaaccagcaagtcatgtgtgaagctggtcttcatgcacgactgctgcagaggtgcagtgctgcattggctgatgaggaccactcactgcacccgcccctgcagcggatgtttgaacgattagcctctcaggctctggaacccatggtgttgaggtaagttctctttcatactcaaatagtccacaattagtaatgtcagtttctagagtccttatgattccagaattcctgccttaatggacatatattcagttatctatgggcaaaatataacaaaaatggacaaaatactcaaaatatggcacttagaaacaaataaatctagttattagtaatcatttagtgtttctgtccatcagttatttctttcatttgaatctagcaagctctcactttcctttaaaaatgaagtcatgcgtttactttatatttaataacttttcatatgtaagaagtttttaaagaaatactttttaaccttttaattttgaaataatagattcaccataagttgtgaatatagatccaagagttttcctgtgctctttgcccattttcctccagtagttacaccttacataactatactacagtatccaaaccaagaaattgatattggtatgatgtattcatgtgcacatacaattatctgttattgtatcatgtgtagattcatgtaatcacca

SEQ ID NO: 14128 - DNA, 1191 bp, Homo sapiens
ctttgaagctagtactatattagtttatgtttgcctgaaaattttgtggtgatagactttagatcaaattaaattctgtttcaggaataatattcaatcttaaatgcctttttaaaattgtggaatatacactacctaaaaatgaccattttaacaatatttaagtgtacaattcagcagcattatatatgttcaggatgttgggtaaccatcaccactatctatttccggaagtttttcatcatctgaaacagaagctctgtacccattaggtaataattcccattcttctctctcctggctcctagccacctctattctgttttctgtctctatgaatttgcctgttctagatattttatattaagtatgatcatacaatattggtcattttgagtctggcttttttcacttagtataatcttttcaaggttcatgtatgttgttgcgtgtatcagaatttcatttctattatggaagaataatctattgtatgtgtataccacattctatttattttttcatctgtttacacacacctgagtcattaacacctttcactattgtgaaaattgctgataagaacattggcatacaaaattctgtttgagtcactgttttcaactcttttgaaaacagaattgctgggttgtatggtaactctttgtttaactttttgaggaaccactaaacttgctttccacagtggctgcaccattttgcatttttctagcaatacatgagggttccaatttctctacatacttactagcacttgttattttccatttttttggaaagtagccatcataataggtgttaaatggtgtctcattgtggttttgatgtgcattttcctaatgactaaattatattgagcatttttacacatgcttactgacaagatacagttgacccttgagcaactcagggcttagggatgccagtgcccctccagtcgaaaatttatgtataacttttgactctcccaaaatgtaactactaataacctatttttttttgttttgttttgttttgtcttgttttgtttttgagacggagtctcacactgttgcccgggctgaagtgcaatggcgctatctcggaccactgcaacctccaagttcaagcgattctcctgcctcagcttcttgagtagctgggattataggcacctgccaccacgcccag

SEQ ID NO: 14129 - DNA, 1180 bp, Homo sapiens
aaccaactcagaagacatagataggccagggagatatagctaatcatctagctaagtctggaattcaggtttctgtggcatttcaatgtacacagtttaatttcaaaatttagtttttatacatatgtgcatatacatttaaacttaatcctctgacaatgtaactgacttactctaaattggaggcaaggaaagcatgaagtaaaaatatgtaaaatgtcagggtcaaaatgggaactttaaattgtggtcttaattgtgacctgtgtaaaacttgattcctgagaattatactatattacatattgtagttagaatgtactgaaatcattttgtagcatttgttcttggctgagtttatattaaaatgaaagattgtaaatctagattgattttataatattttagatttctgatactttaagatgtctgtagattacatttatattaaaaaatgggttgaggaaatcattggtactctaacttgctgttgccagttttctggccgcctgctatttttgcttctgctcccttatctcaacaattgcctgtttttggtcaagactggtaaaaccaagtaatgggcatccaaatacatataaaatacacatgaaacaatatgaaaatggcaaataagtcaggaggaaaatgggtaaaatatatgaataggcatttcatacgagagaaaatatgagatagccaagaaacatgaagaaatactcagcatcattaattgacaaggaagtgcgaactaagaccacaattagatgccattctatacccagcattaaaaagttggcattactacacgttggagaggctgtagatgtggtagttctgctactaccttttggtagtgaagttataaattgccaaacacactttagggaaagtaaaaattggcatcatcatgaaaagttaaatttaagattactccctaactcttaggcatgtacttaagagaaactcggacacatgtggaacatgacacatgtcagaactttcataacataaatgttcataatagcaaaacaaaacttggaggggaaaataagctattgacaagagaacggataattaaattgtgatatatttgtacaatgcagtattattctgcagtgaaaatgaatgaactacaactatatgcaacaacgttgggtgagttttagaaacgtaatat

SEQ ID NO: 14130 - DNA, 1210 bp, Homo sapiens
ttacttaatagatgtttttattttaaaactatggttcaaagctctttaagaatctaccttttttacagaaagaaagagatctcttttttcagcattttattgataattgaaacaataacatctttagacgtgtaagaatgcattaaagaaacaaaatgataaataagactactggcaagatttaaaataacaataatatatataatataagtatgtaccaactggaaaaattatatttatggtattacaaaaaaattaaattacatattcattaatgcattcaataactctgataaagtactggactatatactaggtagtgagagtctaccaatgaaaagacacagtccttatcctcagggagctcacacgctagttggagttagatttaccatgaaacaattgcagtatataatacatgtcacaataaagatttcatgggattttcaaagaaagggtccggacccccattgaagagaaggctttgcagaagaggtgatgatagatctaaaactttaagaataagcaaacatttacctactaaataattaggggaagaagcctcagagcagaagtcacagatttgggaaagagtatgaaatattgggaaatcaagaatagtgtgctaaatagacagaaaagtactcttagggagagtggtggccataattctggacagtgggatggggctgagagggaggggctttatgcaacatggcagagttttgatttaatactggagaaaacgttcaagcaaggtattgaggaaaaccaactgtcaagtcaaaatgatctttctggtggcagaaagaatgaattggacagtttgggagagtgtaaattagtttcctattgctgctgtaacaaactatcacaaactatgtggcttaaaaaaaacacaaacgtattttctttcagttctgcaggtcagagccctaaaatcaaagtggggtcaggattatgttctgtctggaagctctagggcagaattgaagctggctccttccagcttctagatgccagcattccttgacttgtggccccttctgctatcctcaaagccagcagcgtaacatcttccaatcactcccgatgtctctgaccttcatgcttgcttcttatgaggacccacatgaataatccagaataaggattaagagtcttaatcacatctgcaaattccctttttccattcacaggttccagagat

SEQ ID NO: 14131 - DNA, 1318 bp, Homo sapiens
tgagttatacctttagaagttaaagtagttcactatacattccattactgccccaaatcatttcttggatagtgaatattcttccaaactggatagttgtctgcttttttaaaaccaaataattcacatttgatgaatataaaataataccactcaaaaatgtcagttcagtatattgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaaggttagtaattctgtgcatgtttgagaaagaattgaagtattttaaatatttttttgaaataaagaagggttattaaattattccacaagtcttattttcactgccaaatttttgtaccctggttagtctcttacttctctgtcaatttctgttctcccttccatcaaaaccctaattgaaatactctgcttccacaaagtcatccctaataaaaatgcccagtcacgttatagtctctcgatatttgggatagtatatttttagattgtaagcttctcaaaggcaggaggcatattttctacttctttttgcttaaattctccaccataccgtctaccatgcactatctcatgggaggcttc

SEQ ID NO: 14132 - DNA, 1141 bp, Homo sapiens
aatgctagtcttctacagttagtaatatgtatccatggtagtcttctcaacaggggaattgagttaaaatggcacattaaattctacatgtcgtacattaagttcggagttttttccttaatagtattatataacgtggtttgttaaatggtagttttccttagttttttttcattctcaaattctccttttttttcagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgaggtgtgtggaatttcttatcttggggaattccaattcgaagac

SEQ ID NO: 14133 - DNA, 1076 bp, Homo sapiens
cttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgt

SEQ ID NO: 14134 - DNA, 2110 bp, Homo sapiens
gtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattt

SEQ ID NO: 14135 - DNA, 1176 bp, Homo sapiens
tggaaagtatgtttttgggtctttgaattaggttctttttttttttgctttttttttgagatggagttttcactcctgttgcccaggttggagtgcaatggcgcgatgtctcactgcaacctctgccttctgggttcaagtgattctcttgcctcagcctcccaagtagctgggattacaggcatatgccactaattttgtatttttagtagagacggcatttcaccatgttggtcaggctggtcttgaacccctaacctcaggtgatccacctacctcggcctcacaaagtgctgggattacaggcgtaagccactgcacccggcctaggttctttaattaatatatttttggtatttatgtaaaatgtttttctttttctcccccagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcaggtgagcaaataagacagcgttagctgggaataagacttttagagaaggtaatggttttatttgtaaagtatctttttgacacctgaaaataatttcaatctatgcttagctgtgttataactcagtttccacatttgcttgaattcttgccaaagataaacagttcatatttgtttattcttttgggggttttatgaggatacttccaaatagttaaatctgttttgatttgaaataacaaatagcatcagctatgtgttatgaaataacagctggtactgttatatttgttttgaaataacagctgatggtatttgttttcatgtgttctatttgggttatcaatagaatatcctttgtggttattttccaacatagctagacttgtgaaaatatttttcggaaaattctccaggttactaagaacaggatgatgataaaccagtgtgaaaaaatagaaaagggttggataaaggggagtgagagggggagaatgagagagaaggggctctcactaaattcatagaagtgccgcattgattaacat

SEQ ID NO: 14136 - DNA, 3168 bp, Homo sapiens
gcccaaagtaatttatagatttgatgctattcccatcaaactaccactgacattcttcacagaattagaaaagaattactttaaatttcatttggaatcaaagaaggtcatgtatagccaagacaatcctaaccaaaaagaacaaagctggagacatcatgctacctgacttcaaactatactacaataatgcagtaaccaaaacagtgtggtactggcaccaaaacagacaaagaccaatagaatggagcagagacatcagaaataatgccacacatctacaaccatctgatcttcaacaaacctgacaaaaacaagcaacagggaaaagatctcctattcaataaatgatgctgggaaaactggctaggcatatgcagaaaactgaaactggaccccttccttacaccttatacaaaaattaactcaagatggattaaagatgctctcaagtcactccagcacagcgttggtgctgcctgggtatcagaaagcaagctcacattgctctccagtacgtgtaagccttttcttttcaagatgcctgaggaagtgcaccatggagaggaggaggtggagacttttgcctttcaggcagaaattgcccaactcatatccctcatcatcaataccttctattccaacgaggagattttccttcaggagttgatctctaatgcttctgatgccttggacaagattcgctatgagagcctgacagacccttcaaagttggacagtggtaaagagctgaaaattgacatcatccccaaccctcaggaacgtaccctggctttggtagacacaggcattggcatgaccaaagctgatctcataaataatttgagaaccattgccaagtctggtactaaagcatgcatggaggctcttcaggctggtgcagacatctccatgattgggcagtttggtgttggcttttttctgcctacctggtggcagagaaactggttgtgatcacaaagcacaacgatgatgaacagtatgcttgggagtcttctgctggaggttccttcactgtgcatgctgatcatggtgagcccattggcaggggtaccaaagtgatcctccatcttaaagaagatcagacagagtacttagaagagaggcgggtcaaagaagtagtgaagaagcattctcagttcataggctatcccatcaccctttatttggagaaggaacaagacaaggaaattagtgatgatgaggcagaagaagagaaaggtgagaaagaagaggaagataaagatgacgaagaaaagcccaagatcaaagatgtgggttcagatgaggaggatgacagcagtaaggataagaagaagaaaactaagaagatcaaagagaaatacattgactaggaagaactaaacaagaccaagcctatttggaccagaaaccatgatgacatcacccaagaggagtatggagaattctataagagcctcaccagtgactgggaagaccacttggcagtcaagcacttttctgtagaaggtcagttggaattcagggcattgctattcagtcctcgtcgggctccctttgacctttttgagaacaagaagaaaaagaacaacatcaaactgtatgtccgccgtgtgttcatcatggacagctgtgatgagttgataccagagtatctcaattttatccatggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagattataagaaattctatgaggcattttctaaaaatctcaagcttggaatccacgaagactccactaaccgccaccgcctgtctgagctgctgcgctgtcacacctcccagtctggagatgagatgacatctctgtcgtagtatgtttctcacatgaaggagacacagaagtccacctattacatcactggtgagagcaaagagcaggtggccaactctgcttttgtggagcgagtgcggaaacagggcttcgaggtggtatatatgactgagcccattgacgagtactgtgtgcagcagctcaaggagtttgatgggaaaagcctggtctcagttaccaaggagggtctggagctacctgaggatgaggaggagaagaagaagatggaagaaagcaaggaaaagtttgagaacctctgcaagctcatgaaagaaatcttagataagaaggttgagaaggtgacaatctccaatagacttgtgtcttcaccctgctgcattgtgaccagcacctacggctggacagccaatatggagcagatcatgaaagcccaggcacttcgggacaactccaccatgggctatatgatggccaaaaagcacctggagatcaaccccgaccaccccatcatggagacgctgcggcagaaggctgaggccgacaagaatgataaggcagttaaggacctggtggtgctgctgtttgaaaccgccctgctatcttcgggcttttcccttgaggatccccagacccactccaaccacatctaccacatgatcaagctaggtctaggtactgatgaagatgaagtggcagcagaggaacccagtgatgcagttcctgatgagatcccccctcttgagggtgatgaggatgcgtctcgcatggaagaagtcgattaggagttcatagttggaaaacttgtgcccttgtatagtgtccccatggctcccactgcagcctcgagtgcccctgtcccacctggctgctggtgtctagtgtttttttccctctcctgtccttgtgttgaaggcaggaaaccaagggtgtcaagccccattccctctctactcttgacagcaggattggatgttgtgtattgtggtttattttattttcttcattttgttctgaaattaaagaatgtaaaataaagaatatgccgtttttatacaaaaaaaaaaaaaaaaagatggattaaagacttaaatgtaaaacccaaaaccataaaaaccctagaagaaaacctaggcaataccattcaggacataggcatgggcaaggatttcatgtctaaaacaccaaaagcaatggcaacaaaagccaaaattgacaaatgtatctaattaaactgaag

SEQ ID NO: 14137 - DNA, 1194 bp, Homo sapiens
tagtgccatttgtctaagtaacaagctactgcatactcgaaatcacaaagctaagcttgagtagtaaaggacagaggcaagttttctgaactccttgcaggcttgaacaatagccttctggctcttcaataagtacaatcatacaggcaagagtggttgcagatattacctttatgttacttaaaccgaaagaaacaaaaatccattctatttaattttacattaatgtttttccctactttctccctttttcatgggatccctaagtgctcttcctggatgctgaatgcccatcccgtaaatgaaaaagctagttaatgatattgtacataagtaatgttttaactgtagattgtgtgtgtgcgtttttgtttttttttgttttaaccacaaaaccagagggggaagtgtgggagcaggtgggctgggcagtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaatatttttaattgtaatgctgttaaacagacttaaattttctagcctttttaataagcagattagatacattgcaggtctcctggaacaaaggtgtctagatattttgaatgccaatcaaatttaaaacttaaaaatacttccactgggtcctcaaaagaacggaaaccaccgatgctaatcagaaaatagtaaaattaaattcccctttggaataattatacctatataattttcagtgggtgactgtgcaggaatttaaaagaaaagggatcttttatgctaattaaaccaattacaatgctattttttaaatgatgtatctcacttttaaggggaagaaaaccctttctgaatatgccactgctaaatttagctgttaaaatattcaccaagatacctgtatgacactgtgtaggcttattattacaaatagaaaagctgttggctattttcaatgttttcctttgaatttcaaatttttagaacatcttacttaaataacaaa

SEQ ID NO: 14138 - DNA, 1322 bp, Homo sapiens
gttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgttttgttacatatatacattgtataattatcaaagggtaattatcatatccatcacctgaaacacttgtcatttatttgtgctgagaacattcaatcctcttttctagctattttgaagtatacaatacattattattgactatagccaagctactttgcaatagaatactagaatttattcctcctagctaactgtaactttgtacccattgactaacctcccctcatccaccttcccactctcccagccgctggtaatcactattctactctctacttctatgagg

SEQ ID NO: 14139 - DNA, 1843 bp, Homo sapiens
ggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcacta

SEQ ID NO: 14140 - DNA, 1137 bp, Homo sapiens
cccagttttgtgtttgaaacccagggccctggtgatgtaggcacctgcgggaatctcctggtctgcgggttgtgaataccatgggaaaagtacagtatgtgggccggaatacaccatccctcgtggcacagtccctcacggcttctcttggctaggggagggacttcccccaccccttgtgcttcctgggtgaggcatagcctcacccaaggaggtgctttgtatcaggcttagttactgaccagctgtgacctgaacctaagtttactcatctgataaaagagatacctactttttctaccaggtatccacttatttgctgttcagaataaatgaacttaatgagataaagtgtctcttacaggactggcacacgttaggagctcaccaaatgataatgactggttgttatcattgacaattataatatttgtgatttaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggtaaatgctctggaaacattattctttagttaatatcttatcactactatgtcccagatattcttggggcagggggttcagaaatgatcaaagtaatttcttcctcttctgttggagtgaaagtcagttaacaaatgaaaagcattatcaagaaaaacaaagcaggtaagaatgtagggaaggatgtctgtgatgagggtgtaggggggttgggcctgttttgctgctgtctctttagcttctttactcaacaccaacagacacacacatacacattttttctccctctctctgctctataacactgaacattttgtagttttctgagtagacctttttatttcacacctttttcatcttattcttccaccttcagtactttttctttttcttcttagcttcctcctgttgggccttttttactctacttatatcatcttcagactgggttgtgagtctcccattttgcttatgaggaatccttagcatcttctatttcatattgtactgaaattgttgacctactggcctgatcctc

SEQ ID NO: 14141 - DNA, 1194 bp, Homo sapiens
gaagttgatttttctctagtgtttattccagtagtaaattaacagggatggtttgggggttgaccaaagtaatgaaggaatatttggataagagagggggatcttttctgactagtatgaaaaaaaattaaggaataacttgtgaataaggtgaaaaagagaatatgagagaaactactaaaatgggaataattatagattgtaagagaatttttctaagataaaaggttgaattggctattgttgcttttagaattaaagaagactattctgggattaactccgtaccaaaaattggataaatggtggtatttgttgaaaatcaggctcttcaagcattttattttcccacaactcattttgttctttttttttccacctcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaa

SEQ ID NO: 14142 - DNA, 1297 bp, Homo sapiens
ctgtttcctcagagcctgtataatagaaggtaatgggaataagcacttgtttcactattttttaatttatgtctcagatatgcagcaaaatagaagtaatttttcagttattaatttgccaagataatttctgtgttcgggaagtaacagcttggcttctcttttttggttttattctgtgtttctctttggagtttagatagggcacttcttagatggttggtggtagaaaaatattcaagaacattattgggacaagaggttttctttcaggagctttgatattcttttttttcccctaacatgggaaacttaagttcttcttcattttgagatgtgacatcctgtttttctaaagcaaatgtacattttccaaagcttcagctgacaaagagctgctattaatgaaatccttgagtagatggttactttattattgatgcttaaataaccatttatttgtaattattaaaggcttccccctcccttcttttctttgagcagtggtgttgttcagatattatcttctgcagcctgttggaatggaagttttcttgaaaaaaagtaagtgacttagagccttaaaaaaccctcacgtgtacctgtagtctcaagctatttggaaggctgacacaggaggattgcttgagtttaggagtttggggctttaggatgctgtgatcatgcctgtgaatagccactgaattccagcctggacaacatagtgaggccccatctttttaaaaaaagtttcttaaaaccccacatgtgatgcaaatacttactcagcaaaggctgtgaaagacttttcttctctttgatggtggttggccttaatttaatgagtaagctgatgctttgcgcaaaaattggaaagcctaataatggtaatgagaggatttcaggaagagcaatgctgattcatacctggatggcagaaaagcagattaccgagagagactgtatctcagaaataattggtagaatcatcagtaagattttcagagtattctaagatgtgtcataattctaaattcttaattcctcagataattttcttgatttctttggtttgctttcccacagttttaaaatttttattattttttatttttttctctcaaaaggagtgaatttcagggagtaattctaaggaggcttcaggggctccttggatttaggtccagcccagctcaccagagaattatatttgaggttgaactccccagtagtaaatagaatgtttatttgcttagccttatcccttctgcaaatatctccctcaggaacctgatgc

SEQ ID NO: 14143 - DNA, 1185 bp, Homo sapiens
ctggcacaaaaatactcaaaaaatatgtgttgaagaaatgaattttataaaggtgcttactatcactgctattttactgctgattgatttgtcatagagtctggatcataacaacaaattcaagtacatttgatttttcaggatgattcataatctctgagttaactctttagaggagagaagatactcaattttgcttacttttatattaaattatgctaatctgcatgaaatcaatttactttacaaacactgagtgcccactgtgtgccagccatagtgctgggtatagagggtgaataacttctatccttagaagctttgggattagttgagaagggtcaatgtatggaataattgcaatagaatccagtgtatgtgatagaagttgtagcccaggtgccacggtactagggtaagaggctacaacacttttatcagacactaaagaatgcaagttggaggaaacattttaggcaccagatgagttgggactctgcagtttgacacatgatagagaatgttgggtacttgtggagtgggtactggtgtacggatgaagggagactatagtagcatcagagtggaggttatcaaggccttgaacggcgcttggagtagaacatgattggtttctattttagaaagattactttgggggtcctgtggaaatagaccgtgtgcagggatacccattaggaggcttttgaggtagctcaggtaaaggatgttaacagccagaatgaaggcagtgggaaacagagttggttatataaccaaataggagctagtgtctgattatatatggatggtatgagagagttatatattgataataatgctgaggtttctaattcaaacactaataggaaacagagtctataaagcaggttcaagggaaagttccattttgaatatattgattttgatatgtctttgtgatacccaggtgattgtgtttagagcagaaaatttatatatctcaataaagaagtcttatatgaatattttttaattagttatgtgagcctcaatcactattaaatttgaggtcgcttacagcaagaatcaacaagaaagaagtggtgaaatgaaaaacaagagcaaggaaaacgtaatttcttagaggagctatataagttagaataaaatgcagactcttgaggatttgagcataatttgcac

SEQ ID NO: 14144 - DNA, 1166 bp, Homo sapiens
aatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaaggtatgctgattttttttgtataacaaatgatatgaattaattttcattatactttattcagttttcttattccatctcatgaatggaaaccacatttttcttgtttttcactttcgaaatggtttcctattcataa

SEQ ID NO: 14145 - DNA, 1298 bp, Homo sapiens
ttttattcggtgctagagatgcatgtccagtggaaagaaatttttctacttctcccttcctgtggaggcccaggtgcataaggaaggggcaagagcacaatgtatgtgaaaaaccttatttctaaagagaagtgagttcagactaaacaagtggcttcatcaacaaggaaaattttttagccttgtcactacataataggatgggtctagagaaacaagagataaactcaatctcttaagaatcctgttgaaaaaattgggtgatttttttcaaagaaaatatggtaagaaaatatttgctggtgctaaaatacctacaaaattttaactttaaaatatggtgtagctaagaacttaacagcatttgtttttatattagaatcactcggtttgaatcggagctctactacctattagctctgttgcctttgagcaaatcatttaaattcacttaccctcagtttgcttactcataaaatgataataataaaaaaattccatgagtctagtgagaataaaaatgaaacaaccatgaaatatactctataaagcactgagcatggtgcctccatataatgatcactaatatgtaatagctactattatgaaatcaacacagagatttatagaaatcacttgaacagaaaaaggcttcaaaagactggaaatgtaaaaaattcgtctctttgaactaactagtcataattctgggatttctaaaatacaaaaaaaaaaggaggaaataatattatccctatagcttaaaaatattgtggtgggtgtttttatattatgtgagcctcaatttacagaaaactaagcattgtttgaaaaggaaagagaaacattactttttatgagttagtttccatggttgctttgttaatgtgtttgccctagtaaaaatacttttaattcacttttaatttaatatagaaatacttttacttattcacaaaaaagattgcaataggagaaaattttcaggcaatgataaatcttctttctctcctttggacagaatttacaggtccagataatttttgtaatgattaaaagtgtatttcttatgaataaaaatttctattttttgctattaatttgcctatccatttttttctaagcaaatttacatctgcgctaggaagaaaattataatgattattctatccttttgaaaaggcaatggttacactgaatcacctgagttccatctctgggcaacagggacaaatggtcacttgcagtgcaaagatcaagtactgagagtgtgaggtcagctggtttacacaacacct

SEQ ID NO: 14146 - DNA, 1099 bp, Homo sapiens
ggaatatctgagacatcatacagatacgcagctgccatttgtgttctcaggacctttgttagaaaacagagatttatatttaattcattttaaaaacaagttatcacctgcttttgaaacaattgtttaacttcaaattctacttaagtatttttaaagtgtatcaaatttaacaataaattgtcgttgaattcttctgtattcaataggaataggtaaatgttttaagtttttatttgaagtctatctttatatttatgtatttctaatttagttactgtttttgtcttttatatacagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctggtaaggctttattctttttttccccttgtatgtgtgtgtgtatttaattcacagtaccggttatagtcaagttgtcttcagcccaggtaagcatagatgggtggccttatcctgtgtaaagtcaaacattactttcattgtaagccaatagtatttcaaatagtgtcatatgacctaattttgaatgaattaaggggtgattttcctgaaaaaacccaagctgattggctgggaatactgtcactcattcctttgcatagaaacttcgttcatttcactgcagaagaagaaattagagcttacatttaggaaggagttgtttgctagcctgttctgatctgttactgctgagacaccatgcagaaagcaagaatgtggcagaaattttactacaactacttgaagag

SEQ ID NO: 14147 - DNA, 1240 bp, Homo sapiens
gtaatctcatcagcatctttgactttgatggtcacctgtgtggcatctttttctccagcttacatctcttccctaagatacagatctttatttaactaaccactggctctttctcgaaaatttggtagctgccccaaatttaatatatccagaaacagacttcctttgccatcttggtaaattttaatctcaatagatggtaccactaatctgttagcattgaagccagaagtctgggagtcaggcttaactcttcattcatctccccacacttaatgggttctacctcctgaagatcgtgaatcttatcagtttctccgtgtccaacacagaccactattgtctctcaactcaaagccttcttaatagttttttgctctcaagccttcttcacattactctcatagagttctttctaaacaggaactctctaaaacccttcaatagctttttaatgcccataagttcagtttagaacgcattaaaatgattcatacccttactgccttcctgttcagacttgtctgttgcttctctaggttctgacatgtgaatttatctttccattaaaacagttcttttattatttctggcttcttactccataaggaattactaggtcttagattttattagtctttttgtgatgagtgcccatgaacttttgttgtttcccttgtttataccagaggttatgcttgaaattgttacttgtgtttcccaatgttcgtagaccacaaggacagggctgtgtctatctcccagataattcaacagttacagtaatttctgttaaaaaaaaaaaaaaaaaagaaagaaaagaaatggtagttggttacagaaaaaaaaaagtgtattttgaacttttaaggtcttaaattattttatttagggaggtactagttatacagtgaaaagggcatggaatttttctcttacccagctttgtgatgttggaaattgaaccttagttttttcatctagatttggtaggctagtcttggtagttgttacgaggatttaatgagttactgaataaaaggtatctaatagttactagcacataaatggcacctaatgtatgttcattccttatttcctgattaatttgttgggtttctctcacatttcaatgtattacacacacatactacaatcagcatgagattggtttatggcctataatttttggttgcatttaaaaataaaagtattttagctaaaagttctaatagaacct

SEQ ID NO: 14148 - DNA, 1155 bp, Homo sapiens
ataaatgcgtgcttcagaattatacataccactgatattaggagtgattgacacacattcagaaagtatttattaaacctacctggccaaagtagcaaattatgtttgtgtttttttgtcctaatacttttaagttctttaatgtgctaaaaatcaaatcaacacaattcaattttctattatagatactagcttagtattaatattatcatagttaatattctaatcatttatggaattaatttggaggtactatattatgaccaaatatggaaatgcttgattcttactgccagaagaaatagaatagagaataaagtttgagaagatctgaaaaatcatttatgtcttgggttcattttttttaagtaggtgtacatagcatctaacagttaaaaggtaagattagacctaggcattttagtttttatgtgcattgtaataactaatagaaaactgatagaaatatagatgtgtaatatttggtaactctctctttaccagtttgtcactcaagccctatcagaaggttggtttgaattggctggcattggtacataaacatggacttaatggcattttggcagatgaaatggtaagtgtactttatttctaagatttgttgttgaaagtgtcattaaaaggtattcttgctgtcatttaaaacatgaaacttttttttgctactgtagttaactactgccacctcagtaccttatattttatctcatctttgtttttgatagagttagttctaccctcctcactcctccccaagatgaagatagatttattgtctttctgattatcagattagtaaatacatgttgcaaacataaaaatacaaattaaaaaatcgaaatcaaagtcacctgtaattctaccacttaaacaagaactagtttggtgtcttcttttctagatactaccttctgcagatgttgtgtatgtacatgtgtacgtacatacatatatgtgctttttctacagctgcctttaaaattgtaacttagatccctgtccttgtcagtaaacaaatccacatatatatcagcaacatcatttcagctattttatttttattagcggtctctccgggtctctgttctttctcaaatcacattgccttaaagctgagttcacaaagtttgttat

SEQ ID NO: 14149 - DNA, 2248 bp, Homo sapiens
tgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcataagttgtattttcacaccctttttaatagtttctaacccttcctcctcctacccttaaaatcatataatattgggcacaaatgagattatcttatgtgcttaatattgcctgtttgccagtaaattggaacttactacttaggatgtattctcattggttccttcattggactgatgtcagtaaatactgtaacccattatcactacagagcaaatgaagcgagagttggagtaatatcttgaccaactgaagcattttttaaatgcaagctacacaaagaagacatgccttatgcatttttataactgtttgggacccccatagagttttaactttatgccagtagatacttactttgaaacattactgtagttcctaacagttggcattatcgtgtagtggagagacggggtatgaggagatttggtttccatttgtgtgaccttacgtgtgatacttcacagtccataaatttaaggaattcgg

SEQ ID NO: 14150 - DNA, 1187 bp, Homo sapiens
tttgttttgtttttttgtgaaacagagtctcgctctgttgcccaggctggagtgcagtggtgcgatcttggctcactgcaacctccacatcccaggttcaagcgattctcctgcgtcagcctccccagtagctgggactacaggcacgtgccaccattcccagctaattttttgtatttttagcagagacggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacattgtaagtgaacttctaggtatcctaatggatgaatgtttttttgccccagagagtggcattgagactgattggtagttgtcagaaaacaaccccgagacagtttgcttttaaattatgctgtgcataacatgggtaatataaataagaccccaggccgggcacagtggctcacgcctgtaatcccagcgctttgggaggccgaggcaggcagatcatgaggtcatgagttcgagaccagactagccaacatggtgaaaccccgcctttactaaaaatacaaaaattatctgggcatcgtggaagccacctgtaatcccagctacttgggagcctgaggcaggagaatcatttgaaccggggaggcagagattgcagtgagctgagatcacgccactgtactccagcctgggtgatggaggggctctgtctcaaaaataaataaataaataaataaataaaacaccagcccaggagagtaacattgaaaagtatagatgtaatagtagttgtactaactatagtttatggccaataacaggc

SEQ ID NO: 14151 - DNA, 1923 bp, Homo sapiens
ttgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatgagctctcctttttgttgttgttggttggcgagtggtttccatcaagtcatcatgggaaaataatcaagttccatattcacaggttaggataggatgtaataattctcagaagaacccttctagtatgatatttgcttatcaaaatgtctcagaaacaaaatatttgaaaatactgtcacattta

SEQ ID NO: 14152 - DNA, 2266 bp, Homo sapiens
gcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaacttctggtttctcctttttcctttttagactattgaaactgccacaaacttggcaagactttctgaggtttctgattccatatttaattgactattatcaatagcctgatattgaaaaacatttgtagttttcagtgtgaaactaaggggttgaagaatcactattacaatccctattacagagcatttcgggttttgcttgtattttagattctgatacatacgctgtttcactcaggaactacttctaccagttaatcagcattatccagcacttgtctttaaaattcatttggcgcttgtttgttttcaactgaggaaattgagtatagttcattgaagaatggaatttttttttttttttttttttttgctgtttttcatcattcagctagaaagtgagaagttttatcttccatagtccttttaaatcttatgttagaactagcaggacgtaggtggaaagatgaagaaataagcttgtctagactaaagaaaggaaagcaggttataaaagccatagtagccagtccagttcattctgcagatggccccataccaatcgctgttagagtttgccacctccactttcccactgagaactgcagcaattttaaaggatatgagaaagccaagactcaagagatgagaagacccccttggcgaaatatagtgtactcttcactgccactgccaccaccaaatgggtttttagagctttgaaacacaatctttgtaaattaatcaaaacctccctgtgacccacctgccttctccccatacccaaatttgaccactactggcctaaaaggcaagatgggcttcgatatagaaggactgcaagacagtagaaagggctgccacggaggtgacagtagctccttcctctccaacatgtgatgctacacatctctgtggataatctaagttggacttttgactctaaaacagctataatccaagaaagttaaattctaatggaggtaaagaatcttgactgattgttccctttgatgtccaaataagggaactattgtgagtacgtatgctacacttactataagaatgatactgtttgttgtctttctcctgggctggatagtggactatattttattacaggctttgaaagacatctgtaatgttgcatatctgttcatattaataacttaataaatagtatatgaagctataatggcatcatttggtttgtttgtatattttgtctctatttccagctcctagaataaggcttgctattgatgttcaacaaatatttgttgactgaatgaatgaatcctgcatccatgaagtttccagactgcctgaactaattccagaaagatagactgactgactgatagaaagtttgagatttgatagtttgtctgactttagggaaaaaattttaacaaaagcatcctaaaatcgtaaatgtgagagaagttaccatctaggccagctgccagccatcaatttgctaatatgctaggaactcccatctccagcaaaataaagtgcaattcaaagtactcatcattgtacggaaagaccagaaggctgtgcccttatcacaggggctaccaaattagatggtacactgatgtgccattgcagtggatgggagagtctacagactgtactctcgcttatctcctgctactaaatcttagtccta

SEQ ID NO: 14153 - DNA, 1256 bp, Homo sapiens
ccacatatgaattacatcttaaatttcaaaaatcaatgatttaaaaaaatgggacacagtggccagggaaacaagttacaagtgtcactgtttcactcacattttcttcctttctcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagcct

SEQ ID NO: 14154 - DNA, 1163 bp, Homo sapiens
acattgcaaaggaaagcttgctcagagtagacctgcacctggacacgagaggctggagactgtattcaggacagtgctcgtggggagcttccttcactgctccactcttgtgtcctgtgttacaggggctgctggctgttgccactgtttttcagagaatgggctgcctgtacacacctgacttgggtgatcatgtctacccaggaggaccagcaaaaagggacaagcagtgatgccatctggttttacctccagcattccgagcactgccctggccctctcccccagccagtggtcggggttgggtgcgccccactctggctgcacaatagagtaacgcaggagctttaaaaactcccaacacccagagctcacccccagcaaatccgacctaaatagtcaggcatggggcttggacagcagtatgtgtatatattttaaggtttcttagttgaatttaaatgttacagtggggattgaaaatcttggtctagtggtggtagctgttgggttttttttcttttcattttttttgcatccattcctgttactaccctctagaccactgtgatttcttagtctaatcctgacttgctacctgaaaccctctaaatgtaagtctcgtgcaagagagtgagaggtaaagtttggtttttatgataagagataccttgctcagtaagcagaaataagtgccatgtgttagtaactacagttttgttttgttttgtttcctgtgggagcgacagaaaagagtttacagggtgtggtggggaaaagaagaaacgaacatctctctgagggcgagtataaggttgtggacttagtgggaaaagtcctcaacttcaagtcagagagaactgtcgaggagagagactgatgaagaagacacagtgaggtttttagtggttaaaaacacagcactgcgtttacatagtctatttcccccctaacagtggcaacatgttgtggattttctttttttttctttttcctggagagaagcatgctgcctctgaacagtggagaggaggaaaatcatcagcatcctcattggggtcaggtgacctgggcctcgttcttccgctgccacctgccagggttgggattgtcacagaagactgttcctctccgtggtgactgattgcggagagataaggggg

SEQ ID NO: 14155 - DNA, 1562 bp, Homo sapiens
ggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtag

SEQ ID NO: 14156 - DNA, 2062 bp, Homo sapiens
gacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatttctttgggatttcagagggaaatggtgggaatggggaggctgtttgataatctaaaataaattcatgaccatttgagtagaaatgttttttcaggtgtaatggctgtacataaactcagtagagtgccagcagcatttgagatgcaaccatatttttgagagcttttaagacagaatgctgaatattaggggagcattttatgtactgattgtggaattaacaatgtgggcttattcagtgtctgtcattagaatataagctgaaggaagaaagatcttggtgtgatagttttttggttaaaagataaaacaccacactggtgataatgcttttcttagtttgggagattttaaaacaatatggactctagtctaattgcatatatctaattacaaatgttcattggatttaggtgacaaaacacctag

SEQ ID NO: 14157 - DNA, 1191 bp, Homo sapiens
gcaaggtgctaaattactaatgaatatatttgaaattgtagtttacaacactttcttaatatttactggtcattatttttaaaacatttctttttcctgtgggttttaagaaacctaattccaacttgcctttttcctttttttttctttagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaaggtaagagactgacttgggttttttgcttctgccttctaatttaattcagtgaaactttcctggaatagtgaaattggccaatctgtatgaaacccagtgattctcttgactctggtagaatgagtactttataaactttctttactcctagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatggtgagtatgggcttcattcctttttagtttatggaactgctttttttgaagtgcagttttagattaaaaattgttttgttttggcaaaggaaaagtctcttaataagaatttttctagtgaaagaaggggaaaatatctatttgaactacaatgggaaatgatacaagaacagctcagggaaggatgagaaaagatgtttctttgcctttcaatgcctgctaagtgcatgtctcatgaaatgaaaagacagaataaagcagttgtgcagagcatgatctttggaatcaaatacacatccacttactaactcagtgaccctgaacaaacagcttctctcaacctcagtttcctcatctgtaaaatgcaggtacaggttgaacatctatccctaatccaaaaatccaaa

SEQ ID NO: 14158 - DNA, 1243 bp, Homo sapiens
aaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtc

SEQ ID NO: 14159 - DNA, 1191 bp, Homo sapiens
caaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaag

SEQ ID NO: 14160 - DNA, 2311 bp, Homo sapiens
ggtccgattagccttttctctgccttgcttgcttgagcttcagcggaattcgaaatggtaaacttcgcagagacgctcgatgactccgcgggtttttgccggcgagagaaaaacccgttacacagagggatgggggtgaagtggcgacggttgggaacgcgcggagacaggatttagaagagtggggggaggtgttttgtcggctgctagcggagcagcctcggatctcgcggcgggcggcgacggttgggtggcgcgcgcagcgccgctgggggccggcgggcggaggcgcgcggccgtggcgagcgcgcggcggggggcgaacgggcggggtcgcccctgcggcgcgccgcgggccggagaccccggcagggtgcggggacgcgctcgcggcgggacgcgccgcggtgggggatgggcgcgccgccttggtaattctatattctccgttcctcctccgctcgcgggcgtgtgcgcgccgcaggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaatcttaagtagaattaattcctgtcactctcctaggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaactagttgtgtattaaatttgcttggttgtaataggaacttgttttgagtatctcatctagcagcaataactaagcacatttctttgtgactgaactgtcaaatctgtagatcaacaaagtgagatagcccaagtatatttttttaatgttatatgagctactaaagttttaatt

SEQ ID NO: 14161 - DNA, 1205 bp, Homo sapiens
ttaataaatactagtaaatctgtatggtgtttttcatttattactgataatttctttttctgttgttagaataccagaatatagaccattaaaaatggaaaaacatcagttttaaaaattgacattttcagaataaaagaacaaaaaataataatagtatgtttttatttaaggtcatgaaactaatttaaaactcaagagtgttaggaaggaggttttatatagaaatggaaatgcaaagagatattccttttttctacaaagctgatctgtggtatgaccataagctaattgaaaagaaagcatgtaaaattaaactcataagtgtttggtttccatgtggtcagtcataaggtattgagaccaaaacctgactcatgtatgaaggaactaaaggtggtcaggttcaaggccttccaactagagataaagcatttatttctattgcatatactcttgctgattttattttgtctcttagcattgtcactttgtgtgaagtagctacaatttttttttgaagaaaataattccaactttgcccagtggccaaaaattatactttaactcctgacagactatataaaaaaatgtgtgcctctggtcccaggaggaaccaaatggctcagtcagcacaattcatcattactactggcaaaaataactcagcatgcctgcgctgcttggtggtgagtcagtggcatcatattcatatactgacagcaatttttttctttttaggaattaccctctgtatcctgagccaaaacacagagcagtaagattaaattaggtatcagtgttttaaagagcaaaggctgatgttattttaaattattaattcattttaaaaggtcaagtagggtttaggtgctgaggtgatgacagaggtcaatttgatgatggtcttgatcttggggagcttatatcttatagaaaatatgagatgtacttaggtaatattttcagcacagaatgctgagttactggtaatattcagtgggagttcacagggaggaatgagaatgaatacttatgattgggagggtttgttttatttattcagcagtttgaatactactgtgttttaataggaatttttaacaaggagatttaattgtagctctgactgatccaatagtccagcagaaatttactgaacaatcagaataagtgagatatttaaatgaataagaaatcactaa

SEQ ID NO: 14162 - DNA, 1416 bp, Homo sapiens
gacagttttcaacttaagagtcttttgactttatgatgattttattgcgatgtaatgtcattgtaagtagaggaacatctgtacttacaatgaaaatgaaattgaatatattttaatgatccattttatataattgcaatgtatgcattatataatacatatatgcatgtatatttactttattattcagtttaatcaaaagtatatgtaatctctttatatttattgactcctgattgtctttttcaactgcttataattaaatgaaatgtctgtgtaagccacatagaaaagtgcttggcaaagagtaggcattcattaaatgtcaactattatcattagtttagtttttaaatgatacatagtgatacaaagtagtagatattagagagttcagcctggataacttacaaattgattgtatgtgtgtcttcataactaccttgagtggaaagagataaaaaaaaggtaataaattggatggcttggacaaggttgtatgttcagaacctgagctttaccagcagaaaaattgcagcatcatactgagcgatggtatcatttttttggtatcatttttgtatccttctatcccccaggctgaagtgcagtggcacgatctcagatcactgcaacttccacctcctgggttcaagctattctcctgcctgagcctcccgagtagctgagattacagacacacgccaccatgcctggctaattattttacttttgctagagacaggttttcgccgtgttggccaggctggtcttgaactcctgacctcaagtgatctgcccactttggcctcccaaagtgttggaatcacaagcataagccactgtgcctggccaagaggtggtatcttaatgtttagtattgccttacaatatagagaggcagcatggcttaggggccagaacacctaacaaatagctacagacttcaggtaacttattcagttttcatgatttttaaatatctccttagataaatagggataatactatcaagctgatagggctggttgtaaagattaaatgagataatgtaaagaataaagcacagtgccttgtcacatactaggcaccaaacaaattttaattctcttcctcctaaaacagagaagagaaaaatgataggagtgtaagagaagaggaaaattaaataagtggcattgtgtttacataacttttaaaaaacataaattgatctcttggagtttaagttatacttggatttgcaagctaataagaaaccctgaagtgaaggattcttcactatttcttttctgtgaattattaacgtaagttagaattgtctaatttttgatttttaagttagtctccttccataaagcttatttattttttgcttcaaaaatgtgttaatatttttcaccattccattcaata

SEQ ID NO: 14163 - DNA, 1188 bp, Homo sapiens
ttactgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagagg

SEQ ID NO: 14164 - DNA, 1223 bp, Homo sapiens
atctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccc

SEQ ID NO: 14165 - DNA, 1104 bp, Homo sapiens
gttttgcactaacttgtggtccccccaaattcatatgttgaagtcctaacctctggtatctcagaatgtaatcatatttggagaaggtctttaaggggtgattaagataaaatgaggcagttagtgtgggccctattccaatacaactagtgtccttttaagaaggggacatttggacaatggagagagacaccagggatgcctagcacagaaaaagaccatgtgaggacacagtgcaaacagaggagatcggcttcaggaggaaccaaacctgctgatagcttgatcttggacttcactgtgagaaaatacatttccattgtttaaaccacttagtttgtgatactttgttatggctgccatagcaaacttatatacacatatgtaacatttttaaagaaaatgtttttcataatgtttaaatttcaccataatcagaatatatcttctttttctccttgaaattgcaggagcaatgttcctttagttgggactgggggccttcctttcctacccagggaatctggaaagatgttagaattgaagcctataatatttgtcacctgaactacttcacattttccccaatatatggtaagctgaaagatgtgatttttttttctttttgagtcttcttgttataaaaattgggtttataattgaaatacagaggtatgtttttcagagatttagaatttttaaaaactttgtggtacaatcaatttataaaagtaaaaaataggtacaaactgattttacatgaaaattgacaatataaagcagatatgtaggtaggtatcttttagcatattttacagaaaaaggaaaaaataaaatggaagagcagcgccaagttttcctgagataagtattctttcttgaaagaactgggcctgctggctgtgctcctttttgctgcctctgtagtcacttttagtgtcaaattcttgctttgctcacaccgttagactggctttctgtctctgtacattttcttcataacccagagcactactctgagggccctgacacaagggccctgacacaacagccttgtgaagagttaaaaataaactggaaggtaaacagggcaaaagaaagatt

SEQ ID NO: 14166 - DNA, 3023 bp, Homo sapiens
acatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgca

SEQ ID NO: 14167 - DNA, 1128 bp, Homo sapiens
aatttcaaattgaagaattccaaataaaactttattacctctcagtttaactatggtttgtctaatagttcattttaggacaaaatggggagtaaacttctccaactctgaggtgaaatacaccatcttcatgaccaaacacggtgaatcacgttgccatttttcattcttcacatctctcctgtcttaacctcctttccacttccagctgtgcttggtttttgtgtatttttgtaataggatgaatgttgttttcattttctttctcagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccgctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtac

SEQ ID NO: 14168 - DNA, 1147 bp, Homo sapiens
ttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatgg

SEQ ID NO: 14169 - DNA, 1209 bp, Homo sapiens
ccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaat

SEQ ID NO: 14170 - DNA, 1208 bp, Homo sapiens
aaaagaacattacctgtattttttatcatgtgttatctcttaagaagaggcagattagttctaaaatcaacaaattgtatttaattgaaataatttagtgatgaggaagaggtccattctagtgcctgctaaatgtataatccttcttagaatgtgaagttgtccttaaacttttaaataccttcagttaatctttatattgtcatttatgaaaaccttgaactaagacttatgtatctttcatctagctctggttttaatgcaggtagcatttaattgtccccactgtactgggtatagtctgctaaacattaaggagtagttttgcatctctccttgttctgatactagggtcaaagcccactttttatagatgggcagcaaaaggcacattggacatgctgataaatgttgccctaattgtgatctaaacatgataaaatatacatacataagtgcccttatctgctgcaagtgacccttgttttgttttggttggggtggggggtgtttgggatggaatggtgatccacgcaggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagtaagtgaagcccagggcctctcccctctttgcggccactgataggaaagcccaatctttggttgaaaggaagagagttcagcgtgcacttttacatttataaaatgggcatcaaaatgcctgtttggcagtcatgcgataagaagttgtatttgctaatgtgaataacttgagatgatttcattatctgaattgtacagtttagccattaattaggagcagtcagagtgtctgtaaccacatggcctcagttataccataaacttgaaattgtttatgtgctcacatgctacaagtgacggctcctgtgtgcctggccactatattagtatgtattgactccacttccatgttgcagtatctgaaacagaaagtaagtctaatgagaaactttgggattcccaggtcaaataccttccatatgtatgtagcaaaaacaaaatacaaagcctagaagttctg

SEQ ID NO: 14171 - DNA, 3225 bp, Homo sapiens
gtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgac

SEQ ID NO: 14172 - DNA, 1225 bp, Homo sapiens
cataagagatatgaggaaattgttaaggaagtcagcacttacattaagaaaattggccacaacaccgacacagtagcatttgtgccagtttctggttggaatggtgacaacacgctggagccaagtgctaacatgccttggttcaagggatggaaagtcacccgtaaggatggcaatgccagtggaaccacgctgcttgaggctcttgactgcatcctaccaccaactcgtccaactgacaagcccttgtgcctgcctctccaggatgtctacaaaattggtggtattggtactgttcctgttggctgagtggagactggtgttctcaaacctggtatggtggtcacctttgctccagtcaacgttgcaacagaagtaaaatctgttgaaatgcaccatgaagctttgagtgaagttcttcctggggacaatgtgggcttcaatgtcaagaatgtgtctgtcaaggatgttcgtcgtggcaacgttgctggtgacagcaaaaaggacccaccaatggaagcagctggcttcactgctcaggtgattatcctgaaccatccaggccaaataagtgctggctatgcccctgtattggattgccacacggctcacattgcatgcaagtttgctgagctgaaggaaaagactgatcgccattctggtaaaaagctggaagatggccctaaattcttgaagtctggtgatgctgccattgttgatatggttcctggcaagcccgtgtatgttgagagcttctcagactatccacctttgggtcgctttgctgttcatgatatcagacagacagttgcggtgggtgtcatcaaagcagtggacaagaaggctgctggagctggcaaggtcaccaagtctgcccagaaagctcagaaggctaaataaatattatccctactacctgccaccccactgttaatcagtggtggaagaatggtctcagaactgtttgtttcaattggccattgaagtttagtagtaaaagactggttaatgataacaatgcatcataaaaccttcagaaggaaaggagaatgttttgtggaccactttggttttctttctttgcatgtggcagttttaagttattagtttttaaaatcagtactttttactggaaacaacttgaccaaaaatttgtcacagaattttgagacccattaaaaaagtttaatgaaaaaataaaataaaataaaaaattaaaagttag

SEQ ID NO: 14173 - DNA, 1100 bp, Homo sapiens
tgtaatatttcctctaatgctagttaattgcacagggtggaatttttttcttttggaagtcatttagtcagtcttcagaaacaaaccttatagcattattatctactgcaaatttttactgatttctagaacaggcttttgaaacattcatcttttattttagcttctaaatgattatattctaagaccataatcacttcaatttatactttaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagtaagtataatgtcttttttctgttatttgaagctacacagtgataacataattacctgaccatttaatattttaacttcctattaggaataaaagtttatttattttaaaaaaccccagtaaccaatgaaataaagtagccctttgatatagtttgaatatttatcccctccaaatttcatgttgaaatgtgatccccaatgttgttggaggtgggacctggtaggaggtgtttgggtcgtgggggcagatgcctcgtaaatggcttggtgctctcactggggtaatgagtgagttcttgctctattagttcatgagagatctagctgttgaaaagcgcctggtacctcttccttgctctctcttgcaccctctctccccatgtgacatgcctgcactccctttgccttctaccatgactaaaagcttcctgaggtcc

SEQ ID NO: 14174 - DNA, 1106 bp, Homo sapiens
gttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatatt

SEQ ID NO: 14175 - DNA, 1151 bp, Homo sapiens
atatgattaatattttcttaattgttgattttttcttttaatatttatctttcctaattgacgttttcttcttgaaaattgtacctaagtgaatacacagtagaaggatccagtatacagaaatataaaaggaatgaaatcagcaactctttactttggaacacagatgtaatactcattagcatagttacggttattgttattcttatctcttagtgtacctgaagctttctttgaaagctttcaaccttaaatgtggctaaatagcctgttttctgcatttaagaacaaactatatttcctcttctaagtagattcaggaattagtctacttaacatttctgctatttgtttggcttgttgctctccataggaaaactatttttctaagatatttatctattacagtagaaaatgtttttcctttcagactgctttttcatagtggcctatagtataaatttattcctttcacagtgtaatttatcacttttatttttcctataggattttctgccgtctcttggcaaaaatggcaaataatgatgctgttctgaagagactggagcagaagggtgcagaggcagatcaaatcattgaatatcttaagcagcaagtttctctacttaaggagaaagcaagtaagaaaatttaaaattttttgaggagatacttaaaatgaattcatacattgatggagaaaaaataatgtttaccgctttaagttatttaagttttacttagaagtttctgttatatgtagaaaaatatcaaacctgaatttctaccttcaggacttcagttggctttggttttgtttgtttaaatgtattttattttcagtagtcaatgtcagaatagaaatttcaaaatcttttgctgtcactagtagaaataaatgctttcctacgttttgtaagctaatggcttacaaaaacctgtatttactctccagaaactttatcaatttttttctaattttaacataccactttgtttctttttttatagtgtttctcgagattttaaaattatttttcttaaaaattcttactctctttttattaaaaagatgaagagattggacatagtcattgctcatatgatataatatatgttgtaaaccaaattttgtcttctgtaggtggcca

SEQ ID NO: 14176 - DNA, 1224 bp, Homo sapiens
ccacactgataatcctggctgtgatatgctataattttgcaagatgttacctttgggaggaaactggataaagggtacaatggtgactggctatattatttcttacaatttcatgtgactctacaatggtctcaataaaaatttcaaaactaatttttttctggttctaaaaattggtaatattcaatagtggttttttgttcagtgacaaatttgaaatgagatttatattcacaagtactatgttcagtatttttttttcattaagtttgtctaatatgaacagaaggaacaaatgctttttaaaaatctaagtttctaaaattatgaaataattttctttttttcctctcctttagccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttatttatgtgatctattttatattgctttgtttccgtataccctttcctccttgtgaaaaagtttctgatggaagagggaaaacgcaggcatcttttattactggaatccaatacttagtttctaatactgtattacagtgaaat

SEQ ID NO: 14177 - DNA, 1150 bp, Homo sapiens
cgctggaacctgagaagttgctgagtagccgaggagtggctccaaggagcctggaaagcagtcctcctttgaggaccattcaaggtggagtgtgacgttttgtcgattcttgaaagggaattgggaggaaagaggaggaataaagggatgggtgtagggctgtgtgtacagcattttatgtgttttctgatttatcttcacaactttgagacaaactgtcacccccagttcacagatgatgaaacagattcagagtgacagaaggaccaagagagtattcaagattgaacccaaatctgtctctcccaaagccatgctcttccaggtcacacctgtgccttgatctgtctttatgtcaggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtttactgcttttaaaaataatcataatgtaaaaatcactaggctaggagatcttgaaagttccttaaggttctaaaacttgtgactgacaggtgattagaaatatgtgacaaggccgatatgtggtaaggacagtttttagtagtctgtccttactgagtgatgtcatgatgtacttt

SEQ ID NO: 14178 - DNA, 1197 bp, Homo sapiens
aaaaatttttcccattttaatatttaggacaaaaatgtgatgttaaatttattttgcaagaatttgcattttttcctttctgatctcatcattgaaaacccctaaagaaatgaatgccccctgatctagctacataaataggaagtcaccagataaataaggtaaaaagggaaataaggaccagggcatagagcacatctgctataacttcccctatcactctagcacaaatactaattaaatccattagggacaaaccatagagttggctgtcatggcgattctgtggatagagtcctgtcctcaaggaactacatttagtggagaaaagtaacgtacataaataatacaagaaaatgaacataaatgaggaaggaggaagtgctcagcgggggattgatagaaaagcagccagtatccaggctccctcttggcgatgaaaggagcttaaaagctattccgtggtcacagatgatggcggattatccactccagtctgtggcccaatgagaaggctgagtgacttctgttaaaaaacccagcccagaagtgtggttaaatattcgggcttagagaagtactgcagagcctggaggaagaggacacctttaggcaaggtgagaaaagaaaggaatgactgaactctcatgatacagagctgtgaagggagaagcagtcagagactacatggatttggttcagggctttcatttatctgaagatgtcaaagaacttttgtgttacgggctttcggaaattctggcagaaggccaggtgcagtggcttatgtctgtaatcccagcactttgggagactgaggcaggcagatcacctaaggtcagaagttcgagaccagcctggccaatatggcaaaaccccgtctctactaaaaatacaaaaaaattatccaggtgtggtggcacacgcctgtaatcccagctactcgggaggctgaggcaggagaatcgcttgaacccaggaggcagaggttgcagtgagctcagatcgtgccactgcactccacttcatgtaaaaaaaaaaaaaaactctgggagaagaaaatgaggaaggaggccatattattatccagcttctagagagagagtaacaaaagcaaaatggttagctttgaatttatagcaagtcattagtggaacaagaactgcagaggagaaggcgcaacttcccttttgtgcc

SEQ ID NO: 14179 - DNA, 1282 bp, Homo sapiens
ctgaggctcagtaatttatttgtatattggggtgaggggggcaaaatatgaaataaggaccataataaagaatcacgcaattatatttttggattgttatttgatatatcataaaatttgttttggcattttgaaatactatgataataagagaatataaaaacaattcttttcactttttgtgcttataattatatttctgcaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaataccttttatatttgttttttaactgacagtgttaagtttttggtctattaatcattcattcccacccatcttatgactttctttagctacttttggtagcctaagatttcaaaatatggttggcaggatgccttgagagttagcatctttatatccttgtaaatattcaagcacaggctgcatatctatgtcagagttgtcaatgtgaatgtgctagatgagcacatgtagaaacatctctggggccgggcgtggtggctcacacctgtaatcccagcactttgggaggccgaggcgggcggatcatgaggtcaggagatcgagaccatcctggccaacacggtgaaaccctgtctctactaaaaatacgaacaaacaaaaacatctctggaccaatctggtcttaatttcttctatccaggccttttggttctccctggctggccatgggcttcacttctctgatggctcaattcattctttcctaagatcttcaagttta

SEQ ID NO: 14180 - DNA, 1154 bp, Homo sapiens
agcctatattagaaatgattttagaaggagaattagaggaatagggaagatcttaaataagaattgtcaaagtaagggtctttgccttcataatcatttaatgtacacttccttggttttatgtgaatatttgttttaatcctttattttacctttattttaaatctaggatgagttatataataaccctcatttgcttaattttgtaaattaaatgtttagtcagattatgtctgacttcaagtcacatgtgagaaaatgtaaataaggttaggtgtcaatacaagtgaaatgtatagtctcccttttatataacgtccactagtttttttgaattaatattttagaaactctgcctatgcttgaaccttgactccccagttatccttttgattcaaaatcataaacatctttgacttaaaaaagtaactttagcttgaggtgaagatactattgttaacttgattttttatgattttctcctttttaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtaatgttaacagaaatgaaatatagtctgcagcagtaattcctccctcctttcacatggcctttagtggagtggggaaaaagaatgaatacacagtgggaagtaatggaatttgtattagttaatcaaacatatgttgttattttctttctttttttaactctcacttttgcatctttaaatagcacacttttttaatttatggaagacttgtattcttagaatcttgtttcaaaacagttcatgctaaatccagctatgccattctttgtattatttcttgccccaaaaagtaaaaaactgcttagcaattaaggccttcatttgttacttgacagttaagttttctggtattttactctataggatataatttagaatgagtgatatagcgtatgttcatactctgcagatttggagagtgtttaattttcttttaaaaatgttcattgtaaaacttggtttttacatctcaaaatcctgttggtga

SEQ ID NO: 14181 - DNA, 1896 bp, Homo sapiens
aatgccagctactcaggaggctgaggtggaaggattactttagcccaggatgtggagactgcagtaagctatgactgcaccatgacactccactctgggtgtcagagtgagaccctgtctcaaaaaaaaaaaaaaaaaaaaattgggttaaacagttgaatgcaaacaaaaaataagatgcatgagactaaaactggaaatctgtagatatatatgtgtgtatgtaaatatgctacaggttgtgagagtttggtgatttcatctagcatacatttcagtgctcacgagggatatgcttgttgctgtgctgtaatgtgtaacataggtgaaaagagcaatgcagttgcccaacagtaatcccattttcttgttttgcagcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacc

SEQ ID NO: 14182 - DNA, 5483 bp, Homo sapiens
tctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcatcccgatcctactatggtgaaagcattgttcttgggctaaaaaaaaatcctttatttcatacacacatgatttcatacactaggtctgagcatcaagccaagtccatgagtttgcaatgaagttctagtgagaaatgctctattcataaagcagggggtttacgtggaccttctagtgttgcttatgggaaaagagtaactaccatattacatctaacgcaaggccaaagtaccaaattaaaaccatggattgaggtggttattcgaagtcacttactcccatccttctaattatgctccactacaaaagtaaggggagaagagggaatactttacatgtacattgctagagggaaaagaaaggcttgattatatcccctcgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttttttttttttttttttttttgaggtggattcttgctgttgttgcccaggctggagtgcagtggcgcgatctagactcactgcaacctccgcctcccaggttccagcaattctcctgcctcagcctcccaaatagctgaggttacaggcgcccgccaccacacccagctaatttttgtatttttagtagagacagggtttcaccatgttggccaggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaactaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaactgtgtttctgttttctcttactctgggcaatttaaatgggacatctaggacactgagggttcctcaaatactcagaaatgccatttccacacttgacacccataggcttggggcacagagatgagtcactaaaactcctcgctttctagtagagcccaaagatgctgtagccctcaactactactgactaaatgtccataagatgtccagcccttcagtaatgcctttcattgatagattgatagagcatcttacaattcatatgctttctacctctgttggttcaccagagcaatttttttggggggtgggggggatagagtcttgctctgtcccccaggctggagtgcagcagc

SEQ ID NO: 14183 - DNA, 1283 bp, Homo sapiens
caagcccaacgcaccccggagctaggcaaggggccggcagcccgggggatggcttgaccggggagggtcgggccgcagggtctcccgggagccgggggattccgcccgccgcgtgcgcgagcgcgcgtgccccgcgccctcccgcctgccctcttcaactggaaaccagaaacgccggcgcgcctgtggcctgggcgggttggtgcagtaggagctggtgccacggggccgcagctgcgaaaagggggtttcaacttcctgtcctccagccccctggagtcgccggccagtgtcgggaggcccggccgccgcttccttctcctcccgcccggccggagcgcgcccactcccagcttcccgcgggctggtccgggccccaatggccatttgcggcggctgccgggcggagcccgcctcctgggccgcgcgcaccggcggggcaggcctgcttggggtgagctgcggcgtggctggtggcggcggtgggctaggggcccaagggccgcgtctggcccgagccggagcctaagaggcggggacgcgggccgctcggaaggactggaagtgcagcagccacacaggcacagggctggtgccctcccgggccgctgaggccagggggtgcaggggtgggtccggaaggaggttggacactaagggtcgagaccgcagatagacctcggcgtttcggggcagccgaggcccctcgagccccaccgcccggggtccttctctggatgcacttcctcctcccgcttagggggtggtgctggaggcggggagggggcggtggccggagccggcgggcgccggaaccgcgctgctggctagccccgggcccgggtcttctccgcacatgtttgtcatatcctccagccggcctgttcgggcccacagtcctcccgcattagcctgtgtggtcagtgtggtcagcatttgcttctgtgccgaatctctgacttgctgcgtcctggtttaacctgctcttccggagtccgctttccctcgctttgctggctgaccccattcactgtacgcccgccattcctagcccactgcagtcgatactgcctcttatttacttgttgctttttctctgaggccacttcctaggcctgcttcaggtaccatttcccgcctcttctctccattcactcagtactgagccagacaggtctcagccctcgtgggactgaaaatgacaaaaatgtgccaacgtatctactcctgttaggttctgaccactgtttcctcctagttctttatctgtacctttcttctgg

SEQ ID NO: 14184 - DNA, 1158 bp, Homo sapiens
ttgctgcacccaatagaacttcatggcatctttctatgtcctcccggatcgaatgcagggccttctcggcgtctcttcagagggtgcctgcatttggttgcccacgagtctccccgacagcttcaccccgctgtgtgtgggctcgggggatggaggtggggagccgaagggagaaagaggacaccaaagtggacagaggtggagaccctgcaagccatccccagagctaagaaatgggctttgcctgtcagagcctaaggttgcagactacggatcactttgttagaaaataaataatatcaagcaaagtagagtaaaatagaacccttcttctgtgggtgctaggcctcgggcgatgttcattcacaggacactcctgacgtcagtttctccagctacctcttgaaatccgtgacatcgaaggagacgttcttatctgatgaggcggtgtcttgtttatctgtttctccgaacacgagagaaaaaaaagatgaatctcttgcgaatgctgagctgcagctctgggctacagcttcccggcgcgaagttccccgtcccggatcctccttcctctgggtggccgggccatcttgtcaaccgccatgcgccaggggatggatgtttggacaggtgaccaggaccttttggacccatgaattccgtgggtaccacgcagcccatcccttagaacgacccgaggtgcagccgctccacctgaacgtgcccccggggcggcttttcctaggacttcattggccgtctaaaccgggttttgggtacaacctcgccctaccgctttccattgactgaaacagctgctttatcttaatgttcagtttttggccaatgacatggggaaagggcggtggtggtaagacttactgcctgtctccctttaccctgacggtattttcagaggcactaggagaagcgggaacccggagggccacctacgcacctccggggtcgccctcttggcccgggcactagaagtttgcacgtccctccggccaaaaaaaaaaggaatctaatctgcagctgccgccgcacccccacttcccgcccgcatccctagcccgaagtctcaggcagggcatcgcagcccacacgctcgagctgcaccgaccgcccgcggggtccagctggggcgaagcaggg

SEQ ID NO: 14185 - DNA, 1146 bp, Homo sapiens
tgttctattttgtataatcaaagcaaaccaactttaccactcagaaattaaggatattaaatttctgatatttattgggataaatagatgaacctctaaatatttcttcattttaattagagatagctagattttgcattctgccttttgaaagccttttggaatttattaatcatacttcaaaaaatattttaactcctcagaaatatttagaaaggcctaactttattttcaaaatacttgacagataattcgttctacaaacattgtgtattacattaaagaatcattgaaaacacagtttctgtattgaattagagtaaaaaataagctcaattacacatatgtcctctaattgtacaagttaataaatggctgcatacttcgtaccagagttttagcaggttccaaatccatgcttattacaaccaagaagagatgccacaaaggtcgcaggaaatatttttccatgcagactgttggaaggcatgttaatatgaagcccagagattgtgaaagtatgatactccaatatacagcttgagcccaggagcgcctgttagttgtggcaggctgcagtcgtgcacaagtgcttacagctgcagtgacatggtgctaagcatgttttaagactagtcccagttgagcagcatcttatccaaccagaaacaatcccacaatccagctctttttaagtgatcatccttgtatcataacagattaaggttgcagctactttggattatgtttaatctaacctttatccattcacatcttcacctgaaacttacaaggaccaagagtcaattgccgggacataattcacaatgacactgatctttccttcctcgctctaattatctggattaagaataacacttttgagtaattattttcacattggataaacattaagctttcctggatttatctgagctttttcctaacatgaaatagatccaaccaggcttataagaacctaactgacagcagtgacagcttaatcaaggcatccctaaacaactaaaacaataaggaagtgtttattttccattgttaagaatattcaggaatcagaaacttaacaaattttgtggccaaaaaccccctagacaaccaattacaacgctctaactttttttcttt

SEQ ID NO: 14186 - DNA, 1766 bp, Homo sapiens
agtttttaaatatagctttattatctgttctgagatttttgaaaactctgttcaaatcataggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaatcatgtggccctttcaatatttgaactgctaagcaatgacatctgtagttttatctccttttttatgtcatagaaattaatatgatactttaaatatgtaaatataatacattaggtaatgctattatttatatctgtcttaacataatttaagttgtagctgtgtcttg

SEQ ID NO: 14187 - DNA, 1137 bp, Homo sapiens
ttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagc

SEQ ID NO: 14188 - DNA, 1113 bp, Homo sapiens
ccaaatatattctgcagtgatagcagtagcacattgacagaaaatgtagtattttcctcttacacaactgtaaaaattaaagtccttttacattcaacataaaaagtttgatttccccactaataattgaagatgtaatttttagaggagatctacacttgtcatttttaaaagctattgtgacaccagcgttttctcagaagatctaaattttcattggataatttaattgctcctaagcaaagtaatgctggatccccagagaaagatgtatgtgtgtgtgtgacttcaggctcaagaataaaatgagggaagaaagaaatatatttataactgtgaacaattggaagcttggaaacagaatccaacttgaacagtatgagaatggttatattaatttcatactctgaaacctgattggagctccactgaagcagctctttgtttgctaaggtggcatagcaacagcagacacgtctgttttctcattgcaccatcacggacatggtccagcctgtgtgtgaccatcggagactagcgatcatcattcctgtcagtcatcaccatgtctttcacgttcatcttcagtggctctttatcttcatgtctacatctctatgtagacatgctgcatctagagacattggctaccaaggggtttaaggcatctctgtttctattttctgcatacccacagataaacaacaaagccaacgtggtaaccagccccaaagaaaatattcctaccccagcgctggtatacctggactctttgtaacccttcttaagttctttacatttttttttttttgtggtttctctcatttgctttcactatatagatacatatatataaatattttatttcgttgggtgttgggttttgtttttttttttttttgctttctatgatatgaccaagttcatttcttttggttttttttggttaagttagttgtcaagcagtgtgttctaacatgagattatctcatttcgttgttgaacattgtactgatagctgtggtctctgtagttggaattactgcatgctgcattcaaaatacagcgctttggttgctcttagctcttctgatgatgatagttctagattat

SEQ ID NO: 14189 - DNA, 1163 bp, Homo sapiens
cctttccccatcccacttcagccacactgggcttcatgctgatcctcaaacactccatttgggcccttgctttaggaccagtgcactagcttttccttccatctgaaatggtcttctccagttgtcccgatggcaccttctcttacctcctcaggttaccttcttaaaagtttgtgggctccctggactaccctagttaaaatttgtccgcacctttatcagcgacacaccccatcccacttttgtgcatcttttcttcataactcttcacaccatctatattctgtatattttacttattttatgtgttgtctcttcctccctgcacaaaaccatttgctgtgcaaggtagggattattttctaatgactggaataaagtctggcacataataggtactcactatgcattgagggaggggagggaggaaaaaggaaaggaaaagaggaaggagggaagggaaggggaagaaaggagtttctaactcttttgtctgtgcctgcccagcacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatggtaagtattattttcattgcttttgtggtaatatgaaaaatataaattcgtaaatgtttttatttatgtgcagtcaaatattacagaaagaaaaataataaggcatatatttctgtatatgaaagaaataatttcatgttttgatcaatatcaattagctggtataaagttatttgtatagagtactttcaaacaactaaaatatgtgactttaatagaaaatgctaacacttccagatcattaactatgtgccagtctctgtactctaaatacttaaatataccatttcagttaattgtcataacaaatcagtgagatggatatggtctcaacattttacagaggaatcagttgaggcttggagacaagttccttcaggtagtaaagtggcagagatgggaactgaattcagttcttatgctctggactcatccctggtgctgaactgcatactcagaagaat

SEQ ID NO: 14190 - DNA, 1176 bp, Homo sapiens
ggagttttaccatgttagacaaactcttcccttggcggcagaggcctgaggcatgaagcacaggtgtggggttctcaaaatatgccttcacctaaaacctctgacagtgtagcagtgaggggaatgtctgtgggaaggataaggctatggatatagggacccaactagtggttacacggcaacacacaagttgcctcatctaagtctgtaaagtaagggctgcagtatcagctccattaggattgatggagtatcaaataaaattaaacacacaattatttcacacagcacggacctggcacagactgggtgctcagcaggtggccactgcactgatgatgaccacagtgtgtttcttcagcccagttcacttaacgggaaaatgtctatttttccattttgaaaattcaataagaattcaatagaaatttaaaatttaaaccaaaaacattttgtaatttttattttttctttttttttgcatcttttttccagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccaggtaaatgccagcaatttgttcaccttggtcttctactcccattttaattttgttgtttagattataggtttaaaaagctgtgttccctggtgggtagatgacacatataaattcaagagcagatggaaaacaaagtataccgttggtcctttttataaggagagttctgcatcttggcttcaaccaacctcggatcaaaaatactcagaaccaaatattgcattatactgaatatgtacagacttttttcttgtcattatcccctataggataacaattatttacataacgttcacattgtattgggtattacaagtaacataggcagggcacagtggcccaatgcctgtaatcccagtgctttgagaggttgaggtgggaagatcacgtgagggcgggagttcaaaatcagcctgggctacatagcaagaccctgtctctacaaaaaatttaaaaataagtaacctacaggtgatttaagggacacgtaaaatgtgtgtaggttatatg

SEQ ID NO: 14191 - DNA, 1156 bp, Homo sapiens
gcaaatggataatttaaaaataaactttttggaaattcagtctattgaagactatattcaatatgttctgtatattatgcacactaatacattatcatggcttttacctcactttcatatttgactctttgttggttgaaatgattgcaataaatattgataatataaaaatgactctaagccaggtgcagtggttcatgcctgtaatcccagcacttttggtggctaaggtaggaggaaagcttgagcccaagaatttgagacaagcctggtcaacaaagttagaccccatctctacaaaaaatttaaaaattaactgggcatagtggtgcacacctgtagtcccagttacttgggaggctgaggcaagagatggcttgagcccaggagattgaggctgcagtgaacccccttcacaccactgcactccagcctgggcatcagagcaagaccctgtctcaaagagataaaaaacaactctatttttaatgaatccgattaaccttgtggtcaaaatacagaatataattacagtgtttcgatttctctgctttttgtctctgctcatggtagctttagtcttatctgtgtctgacagcagttatgtttggagccattttatattttaatctaataacaattcacatcctatgaaattaggagggaagacctgtagacttaaaggcaggctaaatctgtcatcaacatttcataaaaccagtgttgtcagtaccagctgggggctggagtggatggaatgggagggaagagtagagaaagcaacatttcagagtttggcagaaggcaattttcatattattaatggttttaagaatattaaaaactgcacccttggtgtcgtttggacacactattccagtctggacacacttcctgtttctccattttttttttttcctcttcttacaccctctccatttttttttccttttattcctccttgtttctcttatgaagaaagaagtgagggaagggagaagagaaagaggaacataattattaggattctttcttgttctctttttaactccacactactagattttgctcataattttcacccctacacaattagaacagaaagatattttgtatctcttatgttcttcatcaataacaattgtttttagtagag

SEQ ID NO: 14192 - DNA, 1237 bp, Homo sapiens
tgggatgccaaggaggaagtattgcttgagcccaggagtttgagaccagcctgagcaatatcacgagaccccaactctacaaaaaaaaaaaaaaaaaaaaatgaacttggcgtggtggtgtgtgcctgtagtctcagttacttgggaggctgaggtgggaggatcactggagcccaggatgttgaggctacagtggtccattatcttgccattgtattgcagcctcagtgacagagcaagaccctgtccttaaaaaaaagaaaaaatcccagttgtataaaatagcgtttgttctattttctgaatgaagatttcaatttgtggcaaaaaacccaaacatgtgtttctaagggtgtcctcttgctttatgtcaggaaaacaaacatctctgtcatgtactttgcagaagtcagagagttgagaaatgtggtatttaagtgggctggtctcctttctcacacaggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcagggtaaggcggacagggtgcaggggaaggctttgtgttacccaggggaacccttaactgaaaatcagctttgttcctatgttactaggtatctgtcacttacttttaagaaatggtagtttttgaagagttttggcaagagcaaagaaatggggaaccacactcatacttgactccttgctttttttaataagatgaaaaatacaacatgcttgactgaacagcataatatcgtcaacaagtcttacatgctggatttgggatgatagtcatttctctttaaattttttccaagcagccaactctggtccccagatggcaggcgcacaactgtcttacccaggaggcttccctggaggtcctgcacagatggctggtccgccacagccccagaagaagctggatcctgactctatccctagcccagtaagtactcttctcactctcacagtctcactcacaaaggagcattaatttttctcagcaactcatcagtttgtt

SEQ ID NO: 14193 - DNA, 1138 bp, Homo sapiens
ccaagtagcgccaccactcctggctaattttttattttattttgttttattttttgtagagaagggggtctcactatgttgcccaggctggtcttgaattcctgggctcaaattgtcctcccacctcagcctcccaaagtgctaggataataggcatgagccgctgctcctggctgtattgttttcttgattttcattctgttgatgattaactttagtatagataaggctctggttggctcagtttcccaaattgatttccagaactggttttatgctcacattaggattttttttttctgtcttggcatgttcagcatgtgagcataaatataagatgatgctacatgatcatattgagttcatgtcaagcttaattaaagatttagtatataatatcagtcattttcctaggcctactagacaggcttaatttaattttacaagctattaacattattgtacgccatttgcttgagacgctgtgatattgtttgacatcctgttttcctctctcagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggtaatagttttattattagtgtttattgactgccttgtgtcctggtcatttttaatgagagaggttttcttcatttttaaaatagatgtaactagggcatactgtgttgaagtagtatttggacatttttaataataaagcatctatcttatgtatggctatagttaattgttttcttgatcatgctgccacttatttcaaggtaattgaaggaccctcagaataccttccattcaatgattgaacaataagaaaagacaaaaaatgctgatttcacaaataaacattagaatagtgaaattattttaagaaataaataaggataatttaaaccttgtattgtttatgatggggcccccaaatcagaaatatagtactcattgtttcacagtgcattttaattatgtgtttagatcatggaaagagtggaagctcagatgttgtgaggcagaaaagagaagataggagag

SEQ ID NO: 14194 - DNA, 1069 bp, Homo sapiens
tgtgctgaaatgtgaccatggaaaccaaaagcacaaaatcataggaacactatgagagactatctgtgagatgcttcaggcttccattaaaaaagtggttgcgagttattattcaggtctcatgcttgagaatttgcccaggattattgaagtgatttactgagtttcagagagctatggttaggccctttttaggggataatgatatattgtataatacaaagatttctcatgtacctgatatctgtacttttcctcaaaccatcataaacatgtaataacagtgtttatatttttaatagctttacgtaactaaaactgtcttggtaacatgtttcttgtttctctgttgcagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtacagtgtgttattttgacttgtatgtgattattcagttctcaggctcagagacataagatgttctgaaagaggagatttgaaagcattgaatgatcattatataatgaaatggcttgagattacaggatcatttggaaaaggctctcatagcagaactctacatcactagtttggttattgcatgcaatacaagtttggtttttaaatatagactaaaacaaacacttcctgttttatttttactgtgagtcttgttcttgctgttaattagtggtgtaaggctattgtaaacattgaataaaaaaagaattaaatttataaatgaattaaattcacatatccttatctaggattggccctagataaatctgtacatcatgtgaggataattctttgtacaattctttgtacaaatggaccatgtataaatcaatgagtaactctcagggctcactggaactagcttagatatctgggatccaggctgtgctaggtagaatgtatatagtgcagaatcagcaaggggtgaggactccctttagtgaggcttga

SEQ ID NO: 14195 - DNA, 1268 bp, Homo sapiens
ttcgggagtagcaacatccccatgtacgtttttacctaggcagttcatcagtaaaggtatttgtcaagtggctttcttgtagccgggaagaaagtgcatgttaaaaacaacaacaccgggctggtttttactttgtaagtttgagcaaagtggtagctataccaaacctgggagtggctgaatgtctttctatttagcagtgaaagatgataggaaaccagccagatggtcctgattttagggtgagatagagaggtaagctccagatctcatataggttgcctttatttctgagctgtttctcacaggacggtgagctaaacgctgggtgcttttccatgcagagattcctgtttggggctgggatcagccatcctacttcacaaacaaggaatatgcggaagaaggagtatacacaacgctaacaaccccaatatcaatggaaaccccacttcccacacttttcctttgggacatctcccccaccccccactcctcccgcgttacacgttgccaggctgctttgggcgttccttcctctgtagtgcattgcacgggtacgtcatcaaatgtgcgtgtacacgtgccagattcgcctttaaacggtaatctcccctaggtccagatcgtgtactttcccgtatgtaacggtagtgcagtacctgaactattagttatttaagtaatacgtaatgaatgaagagctgaaactgcaacctgttgatggaagaatgaatgaacgcgctcccctccttcctgcggggctgcgccgagaaaatacggttctgatttagccacgacgttaaaggctttgacctgtagggggaggggaaagaaaagacgggaaaaagaaaaccaaaaaacaaaaaaccggaaaaagggaaaaagcgaaaagggggaggtcgctcggccgctcgcaggctcagcccggtggccccgccccgcggcggccggtggctgtgcgcgtgcgcaggcgggagcgcggcggctggtccaagcccggcgctgggggcgcgcagccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacaggtaaagcctcccacccgcggacgccttcatgcgggacagccctgcccaggcac

SEQ ID NO: 14196 - DNA, 1192 bp, Homo sapiens
atcagaaagtatggattaattattatttagtttaactaccaatggtccttttgaacatataccaattttatgaaattcttttgaaactcacagccttaactgagtcaaattcatttatatgaaacaaaaaaattaaacagaacaaggtgtcaatgaatcagttaaataattcccctttaaagagtagtacagtgatagagcaaattgattaacataaaatatttttaacaaattcttaaaatgaggagatttaatttggtctcaagtattaaaaggaatatgcagcaaatatgctactggcaaatgtttatttttgagtatcggaagtgctctgggctcagtgccctctccacaggaggggaggccacagtccactgctgtcctgcacgacccatgcttggatctgccctgctgtgcctggagccacttcttgaagtagcacagggcatatgcggtggccaggatctgagtgtgtgagaagtgatagcacaggactggttctgctacttcatgtttttctgacatggaggcttcctttatttgtaggtgagcgtccctatcaatgtccttactgtgaaaaaggattcagtaaaaatgatggactgaagatgcacattcgtactcacaccagggtaagattatattctgtttcattaatattgatcatgaaaaccatacttattttaaaagaaatatatttaactttatattacaaaataaaggcaatacactggaagttgtatatctatatttatgacagatatttcaggataattttttttaaagataaaacaatgaaagaaaagaagaaaaaaaacacaaattgaaacctcaaaaaggtttttattctttgaatcaggactcaattttcaggagttataaatgatgaacttcaagataaatagattttaaaattttaatactacaatatttaaaggtttttcttgcagaatattcaccagtaataggaacattttttaatagagtctgcaagtttgtcagcatttggccattaagtaatactgatgagcaagtatatttgcaagaaagacattgcagataaattaccaggacaggtggaaaataaggaagtgtagctcagtgcttcacagggcatgcctagtgctgtggcttattcttcccagggtgccctttgttcctttgctgtcaacactctcactggactattgtc

SEQ ID NO: 14197 - DNA, 1209 bp, Homo sapiens
aaaacctgttatcttttaggtatgctttatttgatacatattatatattttttatttaggtgtcaatgttatatggatattgcataaatacgaattttacataccagtgtaaatatctggttcctgccgagcattggaagctctgcctccatgaggcctttgtggccctgggggaaggcagctctgttctttgtctccatctctgtcaggtcactttctgtatttggggccctgaccctgatttaaactgtcacatatcagcatggttttcatctggaaataggagtccttccttgaatgtaaaccttttctttatatctaagctactttaaaaattcaaaatacgtctgtaagagaacaagctcatatttcatttaggagtagacacatttatgtgtctattatgtggatggtagatgttttttagttgtttgaccatcctttagttttcttaccgtaagaagtaatataaggtaagggtgttttctcttttatcctttacctttatatagatatgagattgtctccactcatttttttaatagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaaggtaaaacttattaatattattattattttttatgaatttgctgctgtgattttcaatttttatttttgataaagcttttgtacatctggggcctactgtatataatgcaacaactagagaagatcactcacctgggccataacccctcacagcctccttcctgtcttccattctcttttgaaactgtccttataagcagagtgcctagtttttcttaacaccgctattagattaattttatggggtttactaattgtgaagtctttattctcttccttctttccataaactttgatgtttttatttacgttagctttttgaaattctcttcatccttgggatccttgtagtatgctctgctaggtcttctgccaatttctctgaacatttttgacttcctttcccctcaggaggttattctggatcctttgcctgtgaacctcttctgtgttctctctccttaagaaatgtcaactacatccatgacttctgctatcaacaccata

SEQ ID NO: 14198 - DNA, 1211 bp, Homo sapiens
actcctgggctcaagcaatcctcttgccttggcctcccaaagtgctgggattacaaatgtgagccactgcatctggctcatgtgaaacttctattgtgaactaaatgcttttcagaatcctgtaacttctgatcttttactgtaattaatgttgcactctctactatgtacatttaagtttaaaatattgttggctactgtaaagggaatattattaactgcatgctacatatttccaagtctaaatttgtgcataacagaagagttactatatattaggtgtaattttttacagagtataaatttaatatgtactaaataggacagctgtattacatttttaaggactgtgagtattatgtctcaaaagatattttttactacataacttatgtccactgcattttcagtgtatataggttagtgtgaacaaattagggctgaattgtaatatatagtttgggtattgcagtggcagctgttcacatgtttacacttttgcttgagagctgtgtaatttactaggctttgacagttgatttaactgtctatttaaccttttgcagattcatgagatatttgattgtcaagaatgtatgaagaaatttatttcagctaatcagctaaaacgtcatatgatcacccactcaggtaaactatatactttttttgtttatagtgatatcattacaaaaaaattacattgtcactttttataaactctaagagtggtaatcaggggccttagctatgaattctgctttggacctttagtagtcatgtgattctgaacaagttatttaattctttagtcctcagtttatttacagagcaaaggtgcttagagtaaatgatattgaagatcttcagaatcaccatgtaatttgtcacttactcctccttgagcctcagtttctttattcttcatttgtgaaatgggatactggtgcctacctttcaaattagctgcaaagattaaatgagatcatttaggtactgtgctagcatagtgtctgacatttagtagatattcaaaaattataattcttgcatttttagatacttttatattctagctaagttactaatacatgttagtaagaaatctataaatacattttgagtatgtaagtttttaaagcggtagtttcatttaagcaagtcttatgaatagctctgttttactaatgcagattaaaaaaataagctct

SEQ ID NO: 14199 - DNA, 1099 bp, Homo sapiens
atatgggaccgtgtagcataattcactctactagcttaatcagcactgtttttatgaccttggtcttttttcacatgtatgtgagattctccttggtaattcaatatagtttgcatcagttggatttttctccttgtgaaggtaaaaatgagctaaaaatgaccaatttcaggaatagcttttgttttctaatttaacattttgatctgaaaagttaacattataggatgaattaaataaggaatttgactttgtattaatttggtgaaatacaagtgattttgaaaataatgtatttctctctagtaacacttgctattatttttttgtggccaaatactattaatatttatagtgataataagaatttattcatatggtatcattaagcacaattaattaattaatttaaaatgagagcaaaactgagcatttcttggctctgaatttttgtctcatgaatatgtttccttgtgaatgtgcagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacagtgcgtatattaaagaaatatctttaaaattataagctaacacagtttattccattcagcttaactcatagtttttaacctgtgtgtgtgtgtgtgcacgcgcgcacgcgcatgttttgtgtgtgaatgagagattaagcattttacattggtattgtcattaactcatcttttcttagtatagtatgttgattattaaaatattcaaattatggattttaacacataaacactgtttatggtaattagtttttgtccatttattaatttgccattatgtatcaagcttactggtttaatctgaaattcagatatgcctactttagttactcctttgaggtaacagacttttagttgtctacgttttatattccttctggaatctgtttaaaaaaaagtttaagaaatggggagttcaaagtataaagaattcctggac

SEQ ID NO: 14200 - DNA, 1217 bp, Homo sapiens
gtattttttctatttcgggaccaggtttcagtaaattctttcaggggacgaacttatttgcacttcctctggtttgtgttagaacttgaaaggctttttttttttttaagttttgtgttagtgttaataataacgaaatcattgatatctcattgctctctgtctgcatgtgtgaatgacactgttgcatgacaactacatttataggccaccacaaagtgttgcttgcataaggccagttagtgatgcaaaattcactttaaaaattgaacataatttcatttgacatgtgtaaatgtcactttttgtcatatgtatttgtattttatttgccaggtaactgaatattgtcacctgcctttttcagcacccagatcaactagaaataaaaaaaagtaataacttttcatgcacacatagtactccattaatgtatcttaaaattatttcttaattactatcagaaacaaatgaatggttcagcatttaaaaaaatttgtttcaggaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaaggtattgcatctttaattggtgatctgggagaagaaaagttgtagaaaaaagtgtagtttaaactgtggttgaattatagttgccttgtaatatggcattctcaaataaagttagtttttgtcaaaattattctcgagggtatcctgtggtggactcatctttgttacagcaggaaaagtattttgggagtgggtgatggatgtaccctataggactgcctaggccgcaggcagggctgcattgctagggcagctcccggctctcactgctctcactggcgcattggggtaatgagtagtgaggatttttatagtcttgccatagctctgccactaatcagtcttgtaacgttgggcaagttgctgactttctgagactttactttctcatctgcatataggaaaaggtgagagtggaggtgaggtacacaagagagcctgctggatccgaaggggattgattcctcttgtttgggatcttttgggaacctgcagcttcttggcatctctttctgttctgatcacagaagcctggagg

SEQ ID NO: 14201 - DNA, 1163 bp, Homo sapiens
tactttattttattttactttgagagatagagtcttgctctgtttcccaggctggagtgcagtggcgtgatctcggttcacagcaacttctgcctcccgggttcaagtgattctcctgcctcagcttcccaaatagctgggactataggcatgtgccaccacaccagctaattttcgtattttttaatagagatggggttttactatatattggccaggctggtctcaaactcctaccctcaggtgatctgcccaccttgtcctcctgaagtgctgggattacaggtgtgagccaccttcctggcatgtttcctactttagctaacctttttgtgtaactactgtaggaagcctgtgcaaatcaaacaggttttcgaactgaggtggtttttactacacgatgagactgttgacttcatcattggccccaggtatgcagaagatgatcctaagtcagatagtaaccaaatacacttcatttccaagaaaattcaaataaaagaagatggtatttggaagactaagtcttgacagtaacataatacactttggcagcaaaaattagggagatgctgaaacatggtactaggaggaattttcagtcttttttattccttagatttaaaaaatgttcaatttattacctcagggttcagtatcaaattaaaatagataaatggagactttaataatagccagctgtctggagttgttttgatttggtgtctctgggaagaggaatgatggattagattacttttggatgtctctttcagatgatatgtcagcaaggcgaactctgtgtttagggtagtgagataaaagtcgtgtgcacaggtaatctaccagctttggtggagtgttgaagactagactggtgcaatgaggaaatggccagccacttgaaagctggagaaaacaggcaggccccagagagcaaagactctctaagaacttaaaagttgtttgggtaagcatatttggaataaaatgggcagtgattctgttaatgaacaaagaaagttatttcaaatatgaatatgtaggtaatgtagtatattgctggttgtgatagtgttgttctgagaataaagataaatcagcacataaatttgtgtgtattaaaagtgatacatttcagaatagttttagtataaaatcaa

SEQ ID NO: 14202 - DNA, 1181 bp, Homo sapiens
tccatgtgccatgcactgctaagtgttttccatgtgtcttaccatttaaacctctgagcctttgtatgagacaaggtatattattcctgtgttacagaagaggaagcagctcaaattttctggggaagattgagtaacttgtccaggttggaatgatgattttaattaagctatcctctgtcagttctttgtttgccatttgagcaatttatatacttgtagagagtctttagtttgtcgtagtaatcttgaatagtgcaaattttctcttatgtctcatttgataatagtatatctattgagtaatcaaggctcattgatctctggaagtgttaaatactacagaaaacagtctaattgtcaaatgtgatagcaatgataataaaaaattagaatattgattatgttcctttatcagaagtaattttgtttgaataacatgtcattattctttctacctccttaatgtagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggtaattattataataatatagtagaaaatagtatttaaaattttgacattatttttcagagttttttcctggtgactagtcccatacttggattaatttatatgagctgttttcccttgaaataattttatgtattttactatcatcataattttgttaaatgtcaaataatgggaagaaattaatagtaatagaccttcatgctatattctggctcattttctcctttatatctggctaaattgttttagtgtatttttggtaaaaatttgaacttttgttcttaggaacttgtaatacttacttaacatcaataatttcttctgtaataataactgaaaagtaaagatgggagaataattataattaatgttttatatgaattaatttttttcttttggtaggaaacaaatgctgtacatgtaaatgtaggagctggctcatatttagaaattaatattccaatgacagttgaagaaaatggtaagctgcaactgttacttttctttttaaataattagggaaataattataaataataaagtttgttaat

SEQ ID NO: 14203 - DNA, 1128 bp, Homo sapiens
taatcccagctactctggaggctgaggcacaagaattgcttgaagctgggaggcggaggttgcagtgaggcgagatgtgtcactgcactccagcttgggcaatagagtgagactccgtctcaaaacaaaaaaaaaaaaaaaaaaatgccaaactgcagaaatactaatgttactttgtgtgacagtacgcatcacactctatcttccttcacactgagcctgtcacttaacagatgaggcttaaggagaaattagggatgtcggttgttaccccattggtttatctggagtgcagtatcaacactgtagcctgatttgttgttctgaaagttttttgaccacatcttgacttaatatttcaaggagctagatgtagccatggatattgaccttcagccacagcaatattaaagtctcaaagggaccttctgttcagctcagtaggaaaatgttttaattactcactagcgtgtgtaacttcatttctaatgctgttcacacagtgtcacattttaagccttaattacttttacctaacatttgttttgcagttccacatcaatgccagctacccccgaatatggaacatgccgcagacatggcagtgtgaattagaggtttataaagccacttaccacttcatctttgcacagaaaaacttctttacaggtaattttctaatagatataaatacagtgagatttatcacagtgaacttgtttacatttgataagttttacttttaaattacatagggatatgatatgattcatattttcttcaacatttcattttgggctgaaaatgttaaagagaaaatttaaatatagacattttgcattcttttctaacctaaacaaggaaaatataaaccccaaattgagcttagaaggaaatgaaagaactcaatttaggctgctgctttgtatcagtctagttggagggtaggatggagatgatgaatcaatttctctctcttcccaaattaggcatcagcatggcttcattattttgttttaataattataatacacaacagtatacgcaaatagctaaatgttatttttatacttggagcccttatttaatcttttctgttggcatggataattgagttggtgctgtcac

SEQ ID NO: 14204 - DNA, 1098 bp, Homo sapiens
aattttttgaaactttgcatctttgaaaactggatctttggtcagtagaattatgccatataggatataaaaactgtaaattctttattcagcgaaaaatatctacttagaattatatttgcttttttatatattcttgagtaatagctcaaaaaggaaggttgaaatgtgtataacactttttttaggtttagtaatatataatatagtaactactataaataatagtagttgtatatgcctacaattatttacctgataattcagtgatacattacttttatagattagggcaaagacttggtgagaaaaaaatagtctttatgaaattttatacagatattgtagagtacagcattaagacacttattcaccatttataataaatgcttttttttatttttataggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggttagtgactttctaatagtaataataatggtgctttagaaaaataacaaagaaaactacatatgcaattcaaaattagtttctggagtgtatttgcctgtctttccctattttggatttatgatatctgcttaaatgttagtcaaagtgtgttggtgaatatactactagaatataatttccaaagtatatcatagatatatttatatccatcatagtcctagcattatgccttgctcaaattagatacctaataaatatttgttgaattaataaattaacaaaatttaagagaaatccacctatagggtgtggaggattttagcaggcagaagtcattttgttattggtagtattttatgtcagttctaaatatttttgtcagtgtttgcttatttcagttaagagttctgaatggcaccttatattcaactcactttttatttttattatggtagaattacatgggtggtgatga

SEQ ID NO: 14205 - DNA, 1198 bp, Homo sapiens
gctgtgaaaagtagctccctaacgagaacaggtacgtcctctagatttgataattacatgtttatatttacgggggaattgagatgaaacaggacttaagtttagttagatatatactttggtagtacaactaatctctcataccttatctttgagaaaaaattttaggaatccattgttctgtttgtaacttttcggagtcttcatgcccttagtttgcatttttaaattgcagctctgacgaatgtcaatgtaggcatttggtgtggggtactgtctagaccagcaacatagaatttcccctgttataataaaaataagctatttattaatgcattaatatccaaataccaacattatgcagtgagaattcaaaaccatctgcaaacatacattttaacttgattcttcaaatataggtatataaattacatttttttgctccttagtatataaataatattatactcagaaacattttattttcaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtattgagttatcacattattttgcttaactgtcttaaggggaacatataccaaaatcttatttttcaggggatgggttaaaaatcaaacaagtactgtttggttgaaattggtccatttatatttttaaatgcctttgataatattgtaattgagagagtagtaagcagtcactcagtgttcttgttgaaaggcaaatatgtcaaatgtgagattgtatataaagagtttaaagcttccttttaatgtggctggtttaagtggtaaatgaaaaaatgcaaagtgtaattacaacatcatatacttgatattacaaaagatagttttaatttatctagatccctctgagacctaataactatcattctaaacctttagttacttaacaaatatttaattaaatctaaaacagtatgtatgtataaggatagataaggatgacatgtgttctgaaaagttaatttcatttttcactaataaatcatgtctgtaaaataacctaaaagtatgcattattttttttcttttcaatttaatcagtcttgaaatg

SEQ ID NO: 14206 - DNA, 1148 bp, Homo sapiens
cttaactctaaattccaatactctacggcaataccatcaaatgacagtaaaagttgtgttatcacttcagtgaaatcatttcttaacataagaagactgattttgacttactagttttagaataagattaagtaagaagacttaaaggcccacctttgaactcataaaaagcctggcctagtgaaaaagcatattttactggtttgcttgcttaaaattatttaagactcatattttaccttggagatgattttgcctataaattaataaagatgtatgtttctggaaaaatggaagaaaaaccgtgtcctttttttatttcacgtttttaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggtaacagacatttttatgttttaaaaatttccatttacaataacaataataccaaagaagcagaagactgttcatcatgttttcttaatgtcgtaagtggataattgaa

SEQ ID NO: 14207 - DNA, 1091 bp, Homo sapiens
tttaaaagaagtaacagctctacagatgaagttaagcaccatgtctgttttcatttgttattccatcccagtatctaacatataataggcatttcacaaataagttagagggaatgaacagacctggattttcttcttccttgtgccattatgtggttgcctgctttctgttttattttttcatttgttatttaaaaaatggtgactatatgtcctcttagatctttcctaattctaatgctacagttttctgggtgtaatttttattaagcaacaggattttgcagcttttgagttttacttaacatatagatttacagtgttgattttaattttctttctgccctgtcttaattatcaaaagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacaggtacaaaaagtcaagtcatattccaggattaagagccaggcatttctacataaccatttctaagtatttagaatataacagtacatttttcagtgtaacagtttataactgtttagtaggtagcaagtaagattgaattccttcaaccattactcatctcaatgtattaaatcttaatctcatgggacttttctctgaagcactcttatatgcttcagaatagtgataagattgataccccccagataactcttaatttttaccttcataaaaagaagcttagtttcagaatcattttattgttttcttttttaacaaggaagtcattggtatggacttgtttataagatggaaataaaaggacatttaagaatactgtttaatgaacttaacctgtaatagaatagggaattccaaaatgcttttatactgtaatatttaatggtaatgaaacttcaaagcagtgtgcacataaaccaggaattttctctttgcaacttaagaccaattttcag

SEQ ID NO: 14208 - DNA, 1143 bp, Homo sapiens
ttaacaatagcatatagagatctatattttactgttacaatttaccttaataacttgtaaccagttgttgaattaatttatcttttaggattctgttcggtaagacagtgttaagaaaaacttcaggttgaggatgggtggcattggtatgtttgtgtttcaggaactgaaatatagtagttttttaatagcataatgggcactgcctaggaaggccataaacaccacaggtgggtggcatagtgagatcatctccccacaactaaaagagaggcttgagatagaaatgtagatagccctttgtatgttaagtaagaaaaaaaatgcacatggcaagtacattgcacttaagcaatttaatttttaaaaggcatctttctaagctgctctttaatgaacatatctaggcttgaccgtttctagatttctattcctatgaatcctgtgaggatttctaagtttaaaaaattgtcaccttttgtcttatttcttctttaatatattttgcagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgagtatcttttatttctatatacagtttagaacttaaaaaataaaacattaagtctccatttgtgaaattaaaagatgcttagatatagcaaatgtttttagactttgagaaagaagggctatttctagttacaggtaacaaaccatattcgtgaaaaactacagcattgagtagttttggtaagtaaaccaaccaggcattctttttggtactataacatttgaatgtttacacagtccctgatttttcctgtaattgatccatgtttgaccagataaagcatttttgacctgtcggaatcttgaaaaaaaatgataaatgtgcaatatccaactcaccataaaacacagaacaggttgtaaatagccaggaccaggaacgccagccttaattaatattgacgtgaataaatccacatgttcaaatttgta

SEQ ID NO: 14209 - DNA, 1370 bp, Homo sapiens
taggaactactagaaccaagatcccaactgtcaccaagactctttgtagctcttgtctttgcttctttgctcccctcttggctacttgtttttcttcttcttctaacttgtaacctctttcttatacatggcaagaaacacagtggagtctcgtttctccaccctcagtcattagagaacgaccaacctttcctcaagtccaggcaaaatatcttatttttccaactttgaccttcacctggaccaattaacctaattaattctgtctaatgagctaaggtcatggcaattcctactgtagctataggatggtggatcaacttggggtcagggagtgaacctgtagttcatagggaaaaagaaaataggtgctatacagaggaaacagtagatgcacactgtacacatagagaaatcaatcctgtagtctgatgtttctgacaagtttagcagtgaaagacattagttattatatgtggccattattactttgtaaagttatttcaatttctatacccaggacttaacaaaaatgcaacttctttatttaaacagaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgtaagtaaactcactgttagaatttttcaggattggcttttaccctgagacagggatattttttgttcagtgttatttagtatattatagttgctatttgtggaggaagagaagggaatggtggttcactgtgtctacatttcataatactgtcttttaatcgagttctgtgctacatgttgactgtcatccaacttgtgctttaacctataggtaaaataataatattaaaactgaaatgagtagggagtggggcagggtggggaatgggaagaaattgctaacaggtatgaggtttctgagtgatgaaaatattcccaactaagattttaatgatggttgtacaactttgtgaatatactaaatgggtgagttttatggtacgtgagttatatctcaataaagatgttcaagatgaatttcaaagcaaagtgcatatacaaaatgaaatgatacattttaaaaatacgtattttcatctatactatacactctgtagtttcaagttattttgtggcaaaaagaaacttattctttgatttcattctggtattgatttttaaaaattattttcaatatcttttaact

SEQ ID NO: 14210 - DNA, 1165 bp, Homo sapiens
tttcttctaagagtttaacagtttcaggtgttaagtctttaatccattttgagttgatttttttgtatggtataacataagggttcaatttcattttttttgatgtggatatccagtttttccggcaccatttgttaaagatcacatggcattatttttctttccttgttgttctgtctttaataaaatctggaaagtaacatttaaatgttataatttgagaaaatgaaatattttccaacatacacagtatattttatatactgatattcagactccttaaaagtggtgattatgtctgtgtcctcatcacctagcaaatagcctggcatataatagttattcagtacatagtagctgaataaagtgtggctccattaaactcactcatgtgaatttacaaaatagtaaaatttatttacagactgttgctcacataacatgttggaaaatagtttgttaaaaagaactctcattttactacaatgtaatgatcaattgttctttctgtagacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggtaagaaattgattggaaaaggatacatgaaactttatctattagaaatactattcatatatcactgaattataacaaacttctccatcccaaaatgcagatttgaagtgtaaatgtaattatagttataatggtcaagtgtatatttcttatacagtttcttataaacaagtgcataatattttctggcaactagaaatggatgtctgacttagatttttgcaagttttttaattaaaatagttatatctttggaattcttttaacacacatgaatttctcagtgtctgtccctgtattatacatatttcagttttaaagaacaacacaatgctcagaagtatcttggttattgagagtttgataagttcataaagaaataagaaagactgggagacagttacacagacctcagtagactgaaattgtgttcagg

SEQ ID NO: 14211 - DNA, 1159 bp, Homo sapiens
aaaccattgaattacacagcttaaattaatgaatggtatggtgtgtgaattatatctcaaagctgttaaaaaaaaaaacaaaaaagggagcggggagggatagcattaggagatatacctaatgctaaatgacgagttaatgggtgcagcacaccagcatggcacatgtatacatatgtaactaacctgcacattgtgcacatgtaccctaaaacttaaaagtataataataataaaataaaaaataaaaaataaacctactacagccattctttaggaaacctacaactatcaatttcagtgccataggcttgctatcaagtcaatgatctcagcattttttatcattaatgttgacactgttaatctctaagaattatcaataattggtacttatggcttattttaaaatattatttttaagaaatgcaattaaatgaggctttggccaggtcatagataaaatgagaaatgaaaccaattctgttctaattcttatggtgatttaacataaatgtatcatactaatctaaattttccttatagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttaggtaagtaatgagtatatacatttacccatatgctaagggattactatgagcaaaaagttatgaataatgtaagttacatatgattatcaaaaaatatattcagaagttagtctcctgtaatgtctatagcttctgtgtgctgtctttgctgcttctttctgtatttgtttctaggtaaggcgaatgaagtacaaatgttgagaatagctcagcactgatgagttgtccaatgggtgacattactaaaatatgagaataattgtccttccactgttgccactagtttttcaccttctcaccaagatgttattttcagggtttgaggtagctactgtaaactgttttgttacttagtatggcaagatgcagcagaagtcatatttaattgttaaggaactattttaatttcttgctgtatatatgtcataacactgtaataaaacctgc

SEQ ID NO: 14212 - DNA, 1125 bp, Homo sapiens
tagggaaaaaatggttctcccttcaaatatgtttagcacatagcactcagtaaattttagcctttttctcccattatgccacatgcttatgaaatctactaaaattaaccagatgtccttttatatgtttaagataactgtataacaggcctaaaatattcaggatgaaatatagtaaacactattgctgtgtttaggttgtcaaagagatttataatcatacatatattattttttgaatgctattattatggtgaatccaggaattatgggctcatttatacaaatgtacctactgaaaatattttgtcttgagtatattatagaggcttagtgatgttcttttcctaccattagaaccatgctttagggcattacactccttaataataactgtaatttttattttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaa

SEQ ID NO: 14213 - DNA, 1306 bp, Homo sapiens
ggataaggaacagctacagtcgctgttaaatgtgcctgaaaagcaatttgcaatctttgcattaggtaagtaccgtttccttccgtagacattttaggaaagataaggtgagaaatgttgacttttgcaaggaactgaacatttatttatttgaacttgctttccagctaaggttactggttgcatttcaaaacaccggtagcattcccactgctaaaactaatgctcttaaagtaaatgctaccgctaaaagaaaaagcagggtccctttcacctttccttaaccgaacagtagacgtttaaagtctgaaacgatcgaatttgtgaaacacagagccgttaatgcctttatgcgaagaggggctagcactcggtgtgtggaccaaatgcgtgtttgtttaggcattgttggcgaccgaatcccgagtgaagcattggtttaaaacctgaatttcccgtctctgtgtattgattcctaacgcgcagaggcgttgcttgaacgttgtttgaactcctaggcattccagggggcaaaagcacctcggcaaaaacgtgcaggactgcatgttactttggttcgcggctgacacgccgactgtgcgccggcctgtcaatcaccgggagcagcaacagggagcacatggcaacgggctgcgggcgagctggccagcggcccgcccggggtcccagcccttcgaagaaagggacattcacgagcttctatctctaattctctgtcgcaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggtaaaaaaatccccctccccctcccggccgcggcagcctctgcctggcaggcgcgtgctccgaggtttcgccggggtactgcgcggctccgtgacccacccgccgacggcggttcgggccccgacccgggcgctgcggagtctcgaacgcccgtgacgtggatttttcgctcgtcaggaagccgccatcccttccttcgttccttgcgaggagcgactagaacccgagttctctgagcacaccgtgccgtcagctggcccgtcacgcactcgactccgccactcccctacttgtttttctgagacttgggaagcctt

SEQ ID NO: 14214 - DNA, 1143 bp, Homo sapiens
tgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacac

SEQ ID NO: 14215 - DNA, 1172 bp, Homo sapiens
agtatgaaatttagagattatgggtcaaaggaagacaaaatactgttttaaatatatattttttcaatttattacagaattatctgttcatttagaacacatttattaagcacctactatgaaccaggcactgctggttttaaaacacacaaagaagattgcatattgtctcttccctggggaaaaaagcttataattttctatcttccactgtggaagacagatctataaactgctaatataatataatatacatactaataatataggcctgtgaacaaagtgttccctagaaaagtcaagggacactttatccatgaagtctcctttaggatatggtatttaagttttgaggaagagtagaaattttcctgcagataagaagaatgtcattgcaggcactgaagtatttggatcagccaattcagattactctgtgaaaacattttaaagtaacactggtaataccagttaatactaacaatacctattaatttacagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggtaagtgagaaaaaaaagtatttgaaagtaaagtgttagaaaagtgaaagaaaagtggtaaaggagattaacattttaaaatgtaagcatggaattttttatctagctatactattttaatatatttcattttatttgctaagtatctcctttaaatccctcccaagtatttttctattgaaaattatcttacaaaattaaatttcagtaatacactgaaagaataattccagtttttctcttcttccctttttcccctgcttccttcatttttccccctctctcctttctttccctcttaccatcctctcccttttcttcccttcccctctctctggcccctgccacaggaccatgcccagtcaggaccctgcccacctttgtttccatctcctgtctccttcctcttccatccactgtgcaccagctgcacgagcaccaatcaaatcttgtttctgttgttccttctgcatgggatattctatcccttgacctttgcacttctggatcctt

SEQ ID NO: 14216 - DNA, 1104 bp, Homo sapiens
accctgtctcaaaaaaaaaaatcacattcaagtatatttcacatgcattttatataattcatgaatttcaggaaagctgcatgtaaatctttttttaaagctaaatcatgttaaagacactgaaaaagttaactaaaattctatggtgacttcttttataaaatactaatttttggccgggcacggtggtggctcacgcctgtaatcccagcactttgggaggccgaggcaggtggatcatgaggtcaggaattcgagaccagcctgaccaacatggtgaaaccccatctctactaaaaatacaaaaattagctgggcgtggtggtgtgcacctgtaatcctagctacctaggaggctgaggcaggagaatcgcttgaacccaggaagcagaggttgcagtgagccaagatcacaccaccgcacttctgcctgtggaacagaatgagactccgtctcaaaaaaaaaaaaaaaaatactaacttttatcttagaaatatagatcattatgcattgggttttttcaaagggggaacactttagtgaacaatagtttacttgacctttagttggaaaagaaaactaatggtggagaattttctttggctgggagaatttggtagattgagagaaaggaagaacatcaatactgcatttttacttgacatttaccctgtagatcctcctagaggttcgatgcccccaagacattccaacactgagctgtttcttctccaggtcttaagctttgaatacaagctataccagcacatctaaaatcggtctctacatttttccatcttaaatatgagctgtccagcttagtcaaaactaactgcaaaacactgggtgtaccatttgagtcatttggtcttaaaagaaacactattatcactgtgtcacagtttgagagattttcacttaagcatttaagttgcaaaccactacatatttgtcccattagtgactagtgggccttaattttggcattcaaattagggtaaaaaaccttggttcttgaaatgctacagaaaatagcttgaggccaggcacagttgctcacacctgtaactccagcactttggaaggctgaggcaggcagatca

SEQ ID NO: 14217 - DNA, 2463 bp, Homo sapiens
aaaatgttctttcaaagtcatgtcttaaactgcttatttgttagaaaattatgagctcttattgttttgttttttgtaactagaattcttttgttcaaaaaatgctattacaatcagagtgacgttattttgtgtcgacttgtgtttttagttatttactaaattgcttcattctatgtatattgtagctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtatgtctgttatcttcttaagttactaaataacattttacttgagaatacaattcttgagaacatattttttagtcctctgtaatgtccttttactttggggtgtatacatgatcaactttattaaagagaaaagagactgggtgtttatggaaaaacagctcttatttccctctatcttcttaattatagtgacatgatactggtaagttttgaattttaaattattaatttaaagtagatttgaatgaaaaacattttaaaataatactggctatatgctggttaaagattattttgttcacaattccaatcagtgagctaatattatcctttgcttctatttttattgtttgtaaatttaatcccatctcaaattttaaaaaactggaaaatataacttttatttttttagcttctggaactaaagaaaaggcatatacacatttaagtttagagtttaaaaattattgtatgtgaattgagaatggtgtgtgtttttttaattctatctttatcctgttgtttgttcccattttacttcccatttcatccttgcctttgtttggcttgctattatcttttcaaagtccttattctccactctaccttctgtttgctttctgctcattgattatcacttcacacttcattatacattcttaactttgcaccatatggttcacagttgtgctcaaatatacctctgatctggactgttgtagtgaagcagctttgattttgacttcaatatttgtttctgccatggttaagtactcctaagtattatgtatgtcagagctgttctagtaaacaaaagaattattactgattttgggttttttttttttttaggtgagcatacttgattcagaggaggtgtgtgtggagcttgtaaaggagtatgcatctcaagaatatgtgaaagaagttcttcagatatctagtgatggaaatacggtaatgtgtagttactttattaccttgcaacttcaaattatcgtttaagcacgtttagcattctaattcattttacaatgatgtaagtttttttaaaatcagtttgccagtatgatagtgtctctggaattcaaaaattgaaatagcatattaaacatatttaaataaattggtgcagtgttaaaaataattatatctagtaagaaaatctaaacttttggtttaagttaaaaagcaaaaaaattacttttacagaatatttaacatttttctataaaataatatttaatgttacatttaaacactttgtatacgttttagcaagatatagtactggaacttaatggcatgtaattagaattttaaaaaaatcttttggcagatcactatttattatccaaatggtggtagaggttttcctcttgctgatagaccaccctcacctactgacaacatcagtaggtacagctttgacaatttaccaggtatgtgaatttaccagggaataaattttgatagtagatttatatgtatatacgtataaactctatatatagatataataaattataaatagcttcagtcaaactttaggtcatatcatattcttgtactttgtttctggtgagagttgtatgcctttaatgcaatgtttattattaatattctgtgttataatggtactatattctatttaaaaactaactctagaacattagtcatatgtctcacaaatgtaatttgtatacttgtttagaatgtggctatagttatgttaaaaaaaattcaacattgtgcttgcttcagagcacatatactaaagttggaatgttacagagaacatggcccctgtgactcacaaatttgtgaagcattctgcatttaaaaaataattcaccatgtatgtggcttttgagctttgaaatcagtgctgctacataaat

SEQ ID NO: 14218 - DNA, 2524 bp, Homo sapiens
ggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaacttcagttgaatgtttctcattctcaggtagtttttcaggcagtatttgaatgaggggaccagacagtgctggtattgttcctttgttcctgttccccgctcccccctccacacagacagacacatgcacacacacacacacacactcctgcttagccctattttcgaaacttgcctgataattagaattgcttaaggtacagattcttagccttcaatccagacgtaccacccgctaagccagaatctttaagagaatgggcctcagaatttatttgtaaggaatacctcaggtaattctgatcaggaacacttaggaaacactggtttttcaagttaatattgaccatctttgttaggcacttgaaatggccttactcaggtaattttggtctgattcccttcatctggttttgtgtcattcagaagacttcacaaaattctaatgtatgattttagaaaacagcaaatttt

SEQ ID NO: 14219 - DNA, 1170 bp, Homo sapiens
caggaggcagagattgcagtgggctgagatcacaccattgcactccaacctgggcaatagagcgagactccatctccaaaaaaaaaaaaaaaaaaaaaaaggcagggtgcggtggctcatgtctgtaatcccagcactttgggaggccgaggtgggcggatcacaaggtcaggagttcaagaccagcctgaccaacatggtgaaaccttgtctctactaaaaatacaaaaattagctgggcgtggtggtgtgcacctgtagtcccagctactcacgaggctgaggcagaagaatcacttgaatcttgcggggcagaagttgcagtgagtcgagattgcaccactgcactccagcctgggagacagagcaaaactctgtttaaaaaaaaaaaaaaaaaaaaaaatggaataaaggacaggtctagttttgtttaaacaggccccaggaataaagacctgtttttaactgtaggctgcttttaaattaagttcagttttgagaattgaattcattcagattaaccgtagagacctcaaggttactagattcctaaaagctactcacctccagaagacccaaatcgggtaagcctggaagttgacaaagcaacaaaagtggatcctgactctagaaatccaaagcagctcttgaccctctagacaacttcagtttcctccaggactcacatggaagcaagccaagtagttattacatatctaattcagtgtttgagtgaaatatgagagtgttgtattgggttaaagggcataggaaatccttttcgtcacatcacgatggctcttcattttatattctttgaataaggaagattccagaagttaccttctcaacacaaatcacaatggcttccacgatgggcagtgatgcttgagaaatgtcatgttgcttaacactcagactttttgaactatgcatcaatgtatttgtgtaaaatacgactgtaagggcccttcatgcaaagatgtctgcaaacattttcattttcttgtaaataattactggaaagggaaaaaagcaattagaaagaaggacttcagcatcctaagttcttgtgccccgtccaaatctgctttctaaagtctctatgggaaaaccagaaatatcattttaatggcctgggggggttcttgcattataagtatacagagc

SEQ ID NO: 14220 - DNA, 1184 bp, Homo sapiens
ttatatgcactagaggggacaagagcaagaagagaacaaggcactgagtttcagagtgactaaggtatagaaattcagaggaaaagcagaggcagaggagcgattaacaacaacaacaaaaaagcagcacaagatttgacaaagaggcaaggggaacaggagtggagatggggaatgagataagaaagctgcacatccagggagagatatggggagaaatgcagtgcttagtagatggcaataagtagagttctgctttgaaaaaagaaatcaaagggcaaaaaagaaaaaaaaatagagaacatatggggaaataactagaaagcagctgaaagggttgcacctggaaggaagaaaaaaataagtaacatgtattcataacaatgtttgagagagggaagaaagattttcttcctcttcaagattcccatcccctctaaaaatacagtcactaagatgcagccatctttgtggtattcattcctccaatcccatttcccccttctctgacatttattttcattcaagtcagttgccagtcactcttactagaaactcgccaaatcatatttcaagaatttgtaaaagacaacgttctcggcaagggggtcttagaggttggctttttcttttggtcatgtggcatcaggttatccctgacagccacacagcagcaggcaagatgaaacttagtttacaggttggagctaagggctcagattacttcctcatgtgacccagttggctttgctttcttctgtggcagcaaactgaatctcgagccccagccagctgtcacaaagctgccaatggtcaaaggatgtccaggctcttaatatagcctgaggagccatgcaaggcacaacttagcccagagagggccaggattagaacctcttgtcctagctcaatgcactttcactacagagaccagatatgagcagttgaaacatgactgtgtaagatttgggaaaaggggtctcatttactaggagatgactatttgggtaactttttttttcttctttcttgccttctacaggactaataaagttttcttgttttttctccctgccctctctttccttttctccacattctggtttggaagctatgatatttcatttctttcagtcatttccattgattaaaaaaatactatggaacttctcaaacacactcaa

SEQ ID NO: 14221 - DNA, 1157 bp, Homo sapiens
tgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagtt

SEQ ID NO: 14222 - DNA, 1231 bp, Homo sapiens
gtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgca

SEQ ID NO: 14223 - DNA, 1239 bp, Homo sapiens
acagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcc

SEQ ID NO: 14224 - DNA, 2682 bp, Homo sapiens
ccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttt

SEQ ID NO: 14225 - DNA, 1185 bp, Homo sapiens
accatttcatcattgctttatttcacttttgtaaattacaaaagttaaacagtatttgtgtactcactgaccatttgtattttcatacttataagttaatgtctcatgatcataatttattttcctgttggggtgttttttatttacatggatttttagatttctttgcatattatgactacattttagacttttccccctgatatttcactgtctttatagttttgaaggttattccaaaattgaatgttaagctggaaagttttagtattctactgaaatggctttgatgtcatgcttcaaaatattttgaacactttaaatacatatattcacacaaatatatatacacccacacaatttatctgtattgtgtttatgactttcagattttcatattctcaatgcttctaactaaaattttggttcataaaaagtatcttatataaaacctatagtaaatattttaaaaatgtgcttttccatttttaataacatgtattttggtaaatacttgattcagagagccaatgaattagagttggcatatgagtttcacatagattcttatactaggtaagtatttaccaaaacatgtatcagaagcagaaagttgttaaaaaggtttaccagacaacaagactggaaagtgtattaagtgtgcctggccttgacatcttgttctggataatctagtctacatcttaatttaggaaagctaatctgtaaaactgttcaaatatttgaacaatatttgataatgcttacataatctttcaagataatatcaggaaacagagttctttcatgtatgtaagtagttaataggacataacatcagatgtctagatgaattatagctatggcttaattacacaataatctgccttcttagtagaaattgcttatttccagcatttgctgtaaaaaaaaaaaagacagtcagtttacaaaaatatacaatcctatggatttaatttatttaaattttgttcattctaattttttttggtgcgtgataatagcaagttatcttagttgaaaatagagattcattcattaaagaatattaaatcttttgtgcccaagtgccttaataaataagtagaatcttaacttttctgataagcattccagtaaaagctaatgtacatagatatgccttgagccactgtttctactttc

SEQ ID NO: 14226 - DNA, 2249 bp, Homo sapiens
tgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttaatcacaggagtctatttttttttttttttttttttttttgagacagagtctcgctctgttgcctaggctggagtacagtggcctgatctcggctcactgcaagatccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtccctttttcaattaaaacctatggtgaaaaaggcgtttgcactccaattttggcttgtgttgttttcttttccttaatattacattttgatcatttaagggcattaaattggcttgttttggtcaggtgtggtggctgctcatgcctgtaataccaacacattgggacgccaaggtgggagaatcacttgaacccaggagttcgagtccagcctgggcaacatggcacgagaccccatctctatttctaaaataataataaattcggttattttgaagctttttcaatttgaggatgctataaaaacttagacttgttgcttgaatcttccataatagtatgtaggagcaatttctctaaacagcattttaagttatttatttgtgggtttttaaaatgtcaacaaaatgcatggcagtatttattttttatatcttcatataaaattaagtaaattatagcattatgaacattttagaaccatgcaagagaagttatagagaaagtaatttatggtgattttcataaagctttaaaatattttcatttgggctataacaaaatgagtacaaaggaactatttagcctggaggggcttttgttatttaaatgtcagatttctttgatacattcttcaaaaataatccttgtcctgcctctatgttccattattgtgtttcttttttttttttttggagacagagtctcactctgttgcccaggctggagtgcagtggtgtagtctcggctcactgcaagctctgcctcccaggttcacaccattctcctgcctcagcctcccaagtagctgggactacaggcgcctgccaccacgcccggctaattttttgtatttttagtagagacggggtttcaccatgttagtcaggatggtctcagtctcgatctcctgacctggtgatctgcccgccttggcctcccaaagtgctgggattacaggcgtgagccacagcgcccggccttattgtgtttcttgaagagattccaattagttttcaattatttaaccaatta

SEQ ID NO: 14227 - DNA, 1164 bp, Homo sapiens
ttttttttttttttttttttgctgccagactgatttggctttgctgggtctgctaacccactccatactcatccagacactttcagtcttccaggattttgttgttcttacctcttcttgtttgttgctctcacctcttgtccttgtgggtttaggtataaaagagtcttttactgttgttttagtcagctttcataattaagtgaaattatatgcatgtttttaatctgccaacttaatcctaaagcacagattatttaaaatgtttaatctatgtcttacctcttgagacttgaaaggattattaaagttagcccttttcatctcttgttttggcttttacattcatatttataatatttgaaactcattatgtggactgctcgagactgtattagttcaaggatttataagtgaattcagaatttgtaaatacaaaggttgattgttctttaaatttgctcttataggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtagacatctcataaaatgttcattatttataactttctcattttgtaagcttcaacaatactattgccagatgaaaaatatactgaaaaacctttttaatgctatttagtatagcttggaaaccagtgaaacatctatgtttaagggaatttgtgtagatataaaacttctattgtataattctatgaggtgtaacagtctcatatcatggactctatgcacaaaattacagcttcacataatgataaagttattttattattttttttctgagagtataaatcctagctgttatttatacaagtcaataggctagtattatgaggacagctttttaaattaaaaaaaatggtattctatcattgtctaattgattatgagtttctttgagttaatattgatggagcaataagatttcttttcattaatatcagaagcatcattgtagtgttctatcagtttcctctttgctttttgtcgtcttagagatcttagtatttcagtctatttctggtgagatagctata

SEQ ID NO: 14228 - DNA, 1352 bp, Homo sapiens
gaaagttataacttttttttttttttgaggtggaatctcactctgtcgccaggctggagtgcagtggcgccatcttggcttactgcaacctccacctcctgggttcaagtgattctcctgcctcagcctcccgagtagctgggactacaggcacgcttcaccatgcccagctaatttttgtatttttagtaaaggtggggtttcaccatgttggccagggtggtctcgatctcttgacctcgtgatccgcctgcctcggcctcccaaagtgctggaatatacaggcgtgagccaccgcacctggcacagttatatttatctcctagaatatgaatatcataatactacctatgtacaattgcttgttaagaacttaattcagtatgttcatgaacttgattactaactcttaagaagcagaatgttcattactgccctcttttgacacggggatgttaagcctgtcttctttttcttagttaagtgttaaaattagattgcacaataagttatgctttatttatgtccttcctgtaatttttaaaataacttttcaaattcttcctctttttaggctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggttaggcattcaatgaattacatttctattttcttcatagaaatttgtgcatgaactaattttgaaattaataggaaacatatttgagagtaaaaatgtacaaagcatgaaattatacatgtacatgtcgtgtatccttatataatttaggtaatagaaggtcaaggaaggtattgcagggcttacgtgaattgttggaacatacatatattagaatgaacttggagggaggaaaggaatggaaagaacactatagtattagttgagagttaaatttaaatccctcataaaacccattgtcttggattatactgtaggtatatactatgcccaaatacctaaattagattcattctaagttagaattttgtatgtgctttacttattatctttgtttcttgattattttatatctaaatcggtgtggagatccattgtattttaatctcatttaaacacgaatttagataattagtaagtcagaaaatgaattcagattttgaaattttatgcgtgtaggattttgaatcattagcatat

SEQ ID NO: 14229 - DNA, 1183 bp, Homo sapiens
ttttggttgccaatgatagatttctgacatctttttcttgtatatttaatagtaatctcaaataatcattttaaaataaatttaggaaaataaaaaatgtaggaaatttatgtgtattttttaaatcactgatgagtttaacccgtatataacctaggttcacagaaataaagtatattttcaagataaagtttttatattttaatgaagtagatatgtaaggttatcccatggaattcccctgaagaatgaattactagattatctttctagtcaaatagcatgcattttgtatcttttatcttaaaaaaaaggagagtctctttccaataatagagtctggaaatctgtgtttacttggattgccaattttaaaaatgttttaaatctgcaagaaagtggaaagtatcttagtaatctccttgacatttttaattcttaaggcagtgtagcatttgtttttgagattatggttctgttgttatttatttttaatatttatttttttaaaatgttccttttcttctttgtttttgaaaatagaaaccttggctatgaaaggattaacattgaactgtttggggaaaaaggaagaagcttatgaattggttcgtagaggtttgagaaatgacttgaagagtcatgtgtgtatcctttttgagatatatttaaggtttgagtggggtgttttgagctaaggcagcaatttgagagtcaaagttttagatctctcttattgtgctattacagaggaaattattttttaaatagggtaacagcaactgccttcattcagggaacatttttatatacctaaccatgttttaacattctcttatttcacagataaatggaacttgcctttaaaaatatctgtgaaagcttttctcactcttaaaaagggggcattgctagggtctgaatatttgtgtggcactccgctaccccatttgttgaaaactaatcaccaatgtgatagtggtaggtggtgggtctcaaaaagaaaaaggatataaaataaggaatattagagcggcattataataccctggtttagagcacaagcttttggagtataggcttagagtgtgcctcacttaggttcaaaacccatttcagcttctttctgtgtgatcttagagctcagtttcttcatgtgtaaaatggggataatcatacccac

SEQ ID NO: 14230 - DNA, 1116 bp, Homo sapiens
aaaaattctaagattagcttggaggcttcattatgttcttaacaaatatttctttgcctccataaagctacacaatatggatgtttgaagtattttctattattgttcccatcattgtgttgtaaaatgcttggggttgtgggataaattaatgtgtgttttttttttttttttttgagacggcgtcttgctctgttgccaggctgcaacctctgcctcccgggttcaagtgattctcccgcctcagcctcctgagtagctgggaccacaggcgtgcaccaccatgcccagttaatttttgtatttttgatagagacggggtttcaccatgttggccaggatggtctcgatctcttgacctcgtgatccacccgccttagcctcccaaagtgctgggattacaggcgtgagccactgcgcctggcctaatatggagatcttttaaaggagcacttgctgttactaaaagcctaagaaaaagtgtttatttttttccttttaaaggaaacgaggtatcagttacttcagcttcgacctgcgcagagagcatcatggattggttatgctattgcttaccatttattagaagattatgaaatggcagcaaagattttagaagaatttaggaaaacacaacaggtaataactagaagccattttactaagtctgatcctaagtataactaaaaaaataatgtgcatagtctggcttacttttaattttgaaatagtttcaaacttatagaaaagttgcaggaatagcacaaagaactctacataggggttcattcatactaaactaattgttaatatttggtgcatttactttaaaatttgtgtatctatttatctattttaattttcttccttaaatgtttgagagtaattgcaagacatcatgctcctttacccctaaatgctttagtgtgtattttctaaaaataactgtatagttttcagttctctagatagtattatagggatagattataaaaattaggaaatttaacactgatagactgttatctaattaatccccagcccatattcagaatttactaattgtcctagttatagcctttctagcaatttgatttcattgcaggatccaattaa

SEQ ID NO: 14231 - DNA, 1574 bp, Homo sapiens
ctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattg

SEQ ID NO: 14232 - DNA, 1510 bp, Homo sapiens
aaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgag

SEQ ID NO: 14233 - DNA, 1225 bp, Homo sapiens
attatcccattcaaatggaatttttttcaacattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttct

SEQ ID NO: 14234 - DNA, 1221 bp, Homo sapiens
gtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaactaagactgaacacctgtatagtttaaaagcaacactatcaatagcatttcagccattttgccagccatgtgtaatcacaactgcagaaataaggagaaaacccctgtttttttagtttagctaattagatctgtaacatcactgggattgctctgaatgaatcctgagagttttgttttttataagcaccctcaccacatgccatagctttgtctcttttagacacctcgatgcagcggctggaaggactggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcag

SEQ ID NO: 14235 - DNA, 1178 bp, Homo sapiens
gcagagatgtgtgtatagcttctcttccatggacaagtttcatctctggaggcgatcagggcagcctgtgtagaagactaagacttaggaattgggctgtgaatagctatccatgtccatttagcaaataccacttcgctattttaagagcaagaaggaaaatgccatttaaatagtgatttagacttacaggaaggacaaggcaaggataaaatctaccgaagattttaagaaaatctccaccctaaataaaaattgaaagcagtacaattttcatgtctactgtatgtgtattttcagaaagggacttttttatgcaaaggacacactgacatcaatgactaatgttaaaaaacaacaattggaaaggttgtgcaatgtggagattcttcctctatatttagaataaaactttgtgtttttactgtcaggatgtgagcttaattatagcatgttgcaaactttgcttttctaaagagagagagagagagagagagagagagtgtgtgtgtgtgtgtgtgtgtgtgtgtgtgtgtgtggcttactctgcctggagaaatttgggtgctatttttgttttccttttgaaacatcaagggttgatataaggtagttttagaagtgtagtatttcttgaccctcaatgaactgatgacctccctgaggccaggaaggatgttttattcagctgttttagcttttatattttataatcattatttacatgaataaaaccaaggatgtcacctgggctgtttggaaggatttcactttgatttttgtttaagcaatgcacaaattattcttctggagataaaatttttttctggcatgaaaacttgcatttagaaaaaaatctgtaattattcattatattattcccataattagcagttatacgtttggtatagttatttattgactattcaggagttacctttgtgcgtttgtacatacctgtgtgcttaacaaaaaaaaaattattgcactgagattattcacattgtcaggctcgttatacagactgaacagtatttggttctagctgtaagtccttcatatcaaccatgaaaatttgctcaagcccacattccctgaatctgagagaatcaccctagatggtttgtggaaataattaataaacttcatctcaccttcaaaaacggctattatgaaac

SEQ ID NO: 14236 - DNA, 1228 bp, Homo sapiens
gttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttgtgtgtgttttgatatagttgcctaagtaaatggggtatttaggtatagtggtgtatccagggttattcaatgccacagaatagtgtatcttatttaagtacccagttactgattatttaggggaataatatttttattaatacaactataactggttatcaatataaatatcataggctattatacattaatttggaaaacaaaagcaaagcactcaaaggatccagtatctccagggaaaaaggaagttgtattttttagggtaggctaagctactttagcaagagacccagtgataaagaatataaatatagaagtttctctcccaaccagtggttccaaggtcagcattgcaggctagcagcccttgttcaaacagttattcagggactttggctgaggatggtgctgccattttaaatcatggctttcaagtcactctagttattcttctaatt

SEQ ID NO: 14237 - DNA, 1189 bp, Homo sapiens
cagttaaaagcaggcagattacacattagaggtagagaatgtgggatgatttgttcacaaaggaatggaatccagagggcataacagaaataagagacaggggaggctggtacggaagttcatcaggcaactgaaggcacagtttgcgcagcaaccaagaaaaggtgggatgtgaggcacgcaagatgtagaggtggggaaaggtttccaacagaattcaacatgaatttgctgtttgagtcaattgatccagtaccaagtctgtgagttcattttcctcttccttttagatttctcctttttctaaaaaagtaaaactgagggggccttcccctgctttccctccttctgcttccctattttccctcgcattcccttccttttctgcagatcctctgcttaggaatggggcattggcccccgcaggagtgggcggggaaggggcggagcgaacagaggtgggcggctcccgtcctatgacgtcagccgtaaggcgctgctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggtagggtgtcccgcgggcgggtgacggttgcgggtccccgttgcgggtccccgagccgcctggcacctccgccgcttctcccctggacgcccctccgccccactgggtcctccagctccaggctggactcctaaagccgcagtgccccgtgcctgtttcctcatttggtgacacacgcagtgcatgcaagaagttggagtgttaccggaaaagggcttgaacccgtataaggctgagaagaagattcactcttttgagcgtgcagaacaaactggagggaaaaaaaaatgagatttaactttatcagaggattcagaggatatctctgaggacgcagaaagttaatccgcatgatcacctcgtgattattttctgaggttctttggccagggcagcacgccctctagattttgtcattttacatattggaatggtgccttagtggtctgggcgttacgttaccgaaataaccaccta

SEQ ID NO: 14238 - DNA, 1552 bp, Homo sapiens
gtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacatatttttagagttttacatttgggttttttgtttgtttgtttcagtcatatgtttggcactgttgtttctattttcgtagttttagataaaatgttaaaatgccaaaccctaccttcctacactttttcttttgccaggaaactggaaacatgtcagttctcctggttcttgattatacagtactcaagagttatcccagttatcccccttcctaaaggttttaacttatccacagttgtgcattgttctgaagattggtctcatatttattttgaaaacactttaaggaaacaatgttcttcgatgatttggggtttatctttttcccaagcttttatgacagtggttaaaaaacagaaatcctcatgtttattccattacctcccattcctaacctgtttccaatcaccaggaagattaggaaggcagattagattaaaaactgaaaattctttgcaga

SEQ ID NO: 14239 - DNA, 1100 bp, Homo sapiens
caacatctatttattgaatgcttgctgtaggccaggacttgttcttggtgctgggtattcagctgtgaacaagacaaagcttctgccttacatgaaacttacattgtagtaggtagagacagacattaagcaaatacataatatggtctctgtaggtgataactactgagattaacagcagttaaccatggtcacaagagaaaactgtggcttaaattgggtctgaagtcattctgagtcaactgtgtaatgcagtggccaaaaagcctaaattcatcttagactatttgaatcaaatggccatgttagagaggtcatgtttgctttcttattgtcaagctgagcctggtgtatagcatttactttttgaagagatattggcaagtggaaacttgttcaggggtatccccatgatagccttgtaaacagctgaagaaagccatcatatttgcatggagtgttccctaggccaaacctttctggttttgccaacagtttctcaaatggtatgatgtctatactctttaactgtcctggtcttcctccagataattaatttcctcttaaaatgatgctcccagaattcaactcatctttccagatgtggtttcaacttaggtaatgcttattagactatttcttcccttgatctggttatttaattttagtaacgcatctgaggattgaatttcctttaaaaacacacacacacacacacacacacacacacacacatctgtgttacttgactctcagtgttgagctaggctgtaaagccaggtctccagcacttctgttcgtacaatttatgtacataaatatgttacccagcatctctattaaaatgtcatctcatcgctgtctgtgcagtattctacattaagatcctttggaatattgtctttcatctaacttggtgttgtctacataattaacaagcatattctcaaacttcatctaggtgtttaatataattgtttaattaaaaaagaataatagcaccagacctttccttcagattatagcagctcaataattaatcctgttttagtatgacatttcaaataactgtgaacagccttaatatgtcatccatttta

SEQ ID NO: 14240 - DNA, 1259 bp, Homo sapiens
taactctgtgctcttgaaatgtctcctacttttaagtcagtttccttatctgtaaactgagactaatggcatttacctaattgggtcgttggagatcaagtaccttaattgatataaagtgcttagaacagtccctgggaggtggtattttgctccagtctgttatagggaggatcattttgttgttagagttcagtgaagaccgttttttaaaatcgtgtggaatgactataggcattataaagacaactgaagaagctcttgtttctgaacagtacttggccagtttctttaacaggagatggctttgcttttagaagcctgccccagagtcttccatctcttccactctccctgcacgtccgctctgtatggcttttgttattaatgtggagcagttgaagtcactgacttgggtgcaggccaggccagcattactgaggtcatatattactttcctagactctagtcatgaacaggatgttggaagtcagaggtacagagaagctgcctttttaggccgctcacatgaaaggtgtgtttgctttcctcaatcatttttatactaatagattggaatcttattcagtatcttggtagcatttttttcttttactctacaacctttatgccgccaggctgtcatttggcttattctttggttagacagactaatgctgttttgttatgcactttcttcattgttatttcattgttgaaacatctcttcctcggttaactaaatatttatttaaggcaggtagaatttctcagtgaagctgtatatttgtttaggtattatagatatattctaaaacatttagggattattcagtctatatatttttttctcttggaaatgaaataatactgtggagaaagtattcattgaaataacaagtgaaagtgtgtttccctcaggaatagtgtaaaaagaacttgcttttattttctgctttgcttttgtatttgggacttggggaaactatgcttttgttattttggaaaagcaatggaattttatcagacattttcctgaaactccctactttctctttttcctgaaatactaccttcaaagtcctgttttgctctgttaggaggttccatcattcaaaaagtgaaagagcttggttagttgaggttattttgttgatctgttggctttaaagaaagaagagactgtcagagaaagtctgagaaacaacacttggaggatcatatgaccaatagtgtgaaactgaggacgctgatttgtt

SEQ ID NO: 14241 - DNA, 1162 bp, Homo sapiens
cccgaagagggctgagctaaatctagggggtagattttgtgccaaggggtgagaggcaggacagagcagagtgtttgggaaactacaagtatttccaatgtggttggaaggcagaggggcaagaagtgacgctggagagatttaggggtggagatggggcgggagttgattggagggtcctgtgtaccctgccagagtttgggttttatcctgtaggcacagggggcagtcactgagcatagggaattggcttcagaatttggtacttttaagttaccccaaaatccagacttaactgttgacttcttgttaacaaattatttgttcaactcaaaattggagtgactattgcatataagaaatggctacaaaataagtttttacatagtccttctcaactatgcagacatcttgcaaatttcagcttcttcattacctgctcgtaatggaagtctagtcgttaaaatgattttttgtgtgaatttcttttaaaattactttgagtatttggttttgaaggtttctagaaagcctgtcctttttgtctgctcctgctctgcaggattggcaaggcagtgtacggctttctctggagctaccaaggcagcaaggataaaaataggacaaactttaagaatctcagatattttcagataacaaagactgatttatgtgggcccgttttgtgctctgacaaaacatagagacgcttttgtgctgtgattagcaagggtgctgatgtcagttctcttgtcgagcatcaagctttattctgtggctaaattgtgctttgtaccataatccagagaacctttgtatctgccttattaaagtgtgtagtttatgtaattgcttttgttttccagcttaatctgtgccagattcaatgagggtgactcattttgtgactgagacaaacattcacatttggaccatgttaaaaataaataaataaatggcaggtgctgcttggctaaattctgtgttttaatgctgtaatttcctgccgtaagggttcacgtcttgtataatgtctactcagcctctgtaatcactagcccaatatatctaatgcacctcaattcattgctactcatttcttgattatttattttagttcctaagggctttttgaattgtaacaatgtgatttcaacaggga

SEQ ID NO: 14242 - DNA, 1201 bp, Homo sapiens
atattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaa

SEQ ID NO: 14243 - DNA, 2093 bp, Homo sapiens
aaatggttaatttataaagtcatgaataaatgagtatctctggataatatttggtacttatgtaactgccttttaaaaactcaagtgtttcttactattttgggaagcttgcatttatttgatattgatctactactgttaattgtgcattagttttataacgtcattattaacattaacattttttattctgtaagtaaaataagtaggtaagattatttggaggctttatagtttgctttgaaagatttatatagcctgggggaaaagtctcatacctattactttgtagtagttgttattactaaagtgttataatgtgtctgcaactatatttcatgtttatattagtcttgtgaaaagtaatccttctgtctgtttgtagacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttaaaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggaaaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgattttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttctttaattgttttctcaatttttattcactttttcctttaggacacatttcccttaattggatatctttcccttaaatttctattagtagttgttttcatctgcccacatgtaattgaagatttaaaaaaaaaattttgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaaaaaatgtaaggctgaagaaaacttacggaggtcacaaaagtgatgt

SEQ ID NO: 14244 - DNA, 2160 bp, Homo sapiens
atttaatagttttcctagaaataataacacatagcaaaattttatatatgtgaggcatcttatataaagggactttacttgagttggtgcaagtgagtcattctagcattagggatggggcagaggtagttatctttcctttgagcagtggacccaggaatatccagaaacagatggtatgtgcagaacaggttgtacaggcactgttttaagcacagctaagtaataccatgagtgaaagtctacttttacctatagtagaatcgtgttgctgatttttgtggcttctgttttcttttttaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagc

SEQ ID NO: 14245 - DNA, 3875 bp, Homo sapiens
tatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgattctgcttgtgattctttggttccagggttaaccaggtaatatagcatgtagatcttgagaatttttgtaaactccttaaaataaatgatttccatgacatgtttccagctagaagacaattctcatacatgcaactaaaagccatgtagaatttataatctatgggtactgtgtaattttccctagtttatataacgaaattgaggccaagttacttgcttagggttatgcaactagtaagtggtaggacttgtatttgagtctagttttaagtgattttatagctagtgctaccattttttttctgcaatgactaaatgggaatgtgcagaatatctaagaatatggattaaattgttttttaatggtttttacatttagcattcagtgatatttatgttggctaaaggtgaaagcaaattgagtgttttgaaaacaaagtatacttactttatactctgaaaactcaatttcttaaagcctgtttttctttataaaagttaccaaagaatattatcaagtcaatacttgtttacatacaatatgaactttctgtta

SEQ ID NO: 14246 - DNA, 1195 bp, Homo sapiens
tagcaatcttaaagcttcttaatgtttttaatctaagtctcttaagattgggcatgttgtatgacatccctaagtctcagtttccttatctgtagaatcagaataatgcttcactgtgctggaattaaacgtaaggatatataaagctgcacagtgtgtggaatgtagtagtaataattgctcagtgtgtgtgttttggcttttcctgttgtcctacttgtttcacagttgtgatacctttttgtgatggtgttagttttaaaaatggcactgtcttttgcgattattttaaactacttaactgcacttacagaaattttagctgtaccctaggtaactttctgataaaattatgttattgaccataaggtttagcagatatctagtcaggattttaaaagcctgagcaatagaaagttacaatgtgatggtctgttcctgtttttaaaaaactgcctgtagttaatgttggaaaatctgtctgtcattaattgcagctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttcactttcttttattgttttctttcttaggtagtgcctctttttagataatgaaagttccaagttggggttataagtatgtgaacacctggataatgcctctgtgtaggttgtgagtaaatatgtctgaacgtagaatctctgaggcttagctttctttttcacacaagacgtacaagatagtgtttaagaggttgggctct

SEQ ID NO: 14247 - DNA, 1193 bp, Homo sapiens
cacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaatttgtcatttcctttattca

SEQ ID NO: 14248 - DNA, 1204 bp, Homo sapiens
tgtcccactatgccaggctgcctctctcattctgtcacagtgctaaacatactgtgctggtttttcacaaggatataggcttctttccatttccccccattccctgaaaatagcagtttcttcatccaattacctctttaccagatccatttttctttttccttcttttccctttcaacttatctggactacttgggtatgtttttacctttgcctgtgtagcattttttacttttttcaggcttctgccaagtctgtctgacattctgttaaggctgttgccacctttcatttggttcttgggtggaagggaagagaaagcatgtcatcacctccatttgaatgtcttgagacttacttattgttcactttgggagtaaacctgatcttcttaattctccccagatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccct

SEQ ID NO: 14249 - DNA, 1116 bp, Homo sapiens
cttctacaaacacggtacatgtttctccaaagcatgtcggtacctggagaaacaggttgcatctttctagagaataaagtttccttgatggcacagctgtttatagagtggaatgcagaagtcacttgaaatgttaagctaaaactcaaagaaagttggggcttcttagagggggcggcgactttaataccaagttcccctgcagtgttgttctttcttggcctttggggaaactggtggaaaagtttgcaaaacaggctttttccctgttccatgtttgactcacatgagaaaaatagcattctaatttacaattttgaaaatagttcttatttccatcactgacagatgttacctttatgattgttcagcctattcttccatttcatttatgcattggacaaataataattgactgcctgctctgtgttcagtaccaacctaaatgccgaggatgcagcagcaaccaaaataaagtcctccctcggagcttgtattctaaaaaacagtgaggtttgagggcagacctgaggaattaggggaattaagcatgtggctgtttcaggcagaggaagagcaattgcaaaggccctgaggcaggagcttattttcctagtaagggagagtgttaggagaggaggtcacaaggagatgattagggatgccttgaggttcaggtaagagttttgtattttatactgagaaacatgggaaaccattgtggaagtttgagaacttactttggctgctggttgagaataatggagcaaggttgggaagtgaggagaccagttggaaggctactgccatagtacaggtgggggatgacagcactgggtaccaggttagtagtagtggtggaaatggtgcaaagtggccagatttggtacctctgttgaaggtagaaccaacggaatccgagaatgaattggatgtggggtctgagagaaagagaagagtcaagggaggtggcatggttttgggtctaagtaattgaaaggatggaggagttgccattcctgctgagacgggcaggtagagggaggaacacgggcagttcctcggccatggaaggtctggctaagcactttatatgaagaatactgaaactgactt

SEQ ID NO: 14250 - DNA, 1981 bp, Homo sapiens
aaatgatgcatatattttatatattgtatggacatataattaaaacattttggaggaatcctcctttattgcatccttttctgttcatacagaatccttgcgtgaatatgttctacaaaggcatccagtttcagtctgaagctacaaaaaggggccacaggatcagaagttcagccactgattgagtcacctaaataaaaaacagaattggaaagccaagagtgccacttgcacataaggagtgggaattcgaactgaggtgctggagaaatcctaaagatgaacaagatttcagtgaggagaaagccctcctgtcagtggtccccctgcatctccttatgcaattagactttttaggtttccctgctccctttcaggagcattggcatcaacgttattctctcagtttatgaacacagtaggggaggggccattcctgtacatctctcacagtcagattaaagcaaagcctagagtttgtaaacataattcaggttctaattgccgagctgagattgggaaagaatttttcctaactctggtctagcaagtggctgtagggaggcctttctcaaaaatcagctgtatttgcctttgacattgtccaggagcagagcaccaggctttatgttgcttggcacaaggcagctcctctggttatgtgactcctgctgagaggattttcacaatttattaatgagctttccacaaccctgctttattctccaaacagttttacgctgtctctaggaacaacaaatatatctgggcactgtggttgaatgaataccagacaattgtgtgaatgttgtattggacttcctcttccctcccttcccaatctaaatagcattcctatttcaggagccgatggtgtgattcgaaacaactgcttggttgaaggatggggggcaggatcgagaaggagagagggaaggggcagtgctgattctggagaggtgtatgtagtgttttgtcttggtttattttaaagatcagagagtaattggaaacaattattttttaattaataacttgggaaaggtgaacagaagcatttcacagggttttaccgtgtgcacactgaaaataaaacactttatgctatgcttcaataatttatcacttcttgacaggggcttggaaaaggtccagtatgtaagtacaaatcaccaatttgctcttttataaatgagttcttttaaggagaaaatggatggctctccaagtggagcatacatgttctcatttgttttgtagaatatgtggggctgcaggttattgtgtcccttcattcacttatatcagccacctctaaaagcaattccattgtagtctcccactaatctgtagcgtcctgttttttctaacttcttccctgacctcgcctttgatatataagtctttattttccccttgccatctctctagtttaatagctctacagtggagtactgttttcaaccatggaactacttttaatcaagatcaactttgggaagtgctgccatttttatggtaataaaggactgtattatgcacttgaacccgctcaagttgtcccctgtgtataccttcacatagtagaaccatgaaacaaagtgtaaatgcttaaattgctttgttcttaactgtagtctcctagaggtcagtgaatgatttctagttgcattgtagcgaagacatttgttccaggttgaagaattttttacttgagaacatacattttccctgtctgtgtgcccccaaaccctgtctgccacactctttctcttgggctgtgacaaaacagaatgtttagcgagaaacaaaattgtgctcgattttcagactatctgacttcattttctgttttggtctttgagctattccttggctaatcttccaacaagtcgaattgattcttatttcaaaactgtttatcccaaaacagagctgttgacaagtacaaatacagatggcagacatgtggtatgatttt

SEQ ID NO: 14251 - DNA, 1421 bp, Homo sapiens
agaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactg

SEQ ID NO: 14252 - DNA, 1135 bp, Homo sapiens
tgtatgggctttaggggtcacaaaacctggatctgtcccttctgataaaattctaattataaatgagtggatcaggcataaattttaaaattctgtaaaatgatggccggcatttcttcactccctagaaactttggaactgtttaaatttataataaatgcttaggtgtatatctatatctaaattatctattttttttaacttctgggaatcaagataaacatcgtaccaactaattatatgtttttgtaagtatagagattactttattccctctataatgttagtcatgttaaaaaggaaaaggaaaagaaaaaaattcctacaataatataatgtgccagtttgtatatttctgtgtactgatacaacaattataagtaggaatcaaatgaattcatttcagaaagtctcaatggatcgcctacattttgaattgcaatgcaattcatctttgtagcctttagcaacacctaatttagtgccccatatgtagtaggtcatcaaaaagtagtttttgaattgaaaataaaataagtatatgcagtgaactgaatcgcttttaaaactaaaaaggtatgttggcaagatctctctgatttgacaaaaataaaacatataacctaaatatagtggtttgcacattgatggcaagtagtttttatagagcagaactctctttttcagaaattgcataaccatgttttgcaagtacaattaatataatatcacaagcctattaccacattattacctgactagtgaatgcatggttaatttaggcaacctatgtgccttttctggaaattcacatactgtcaaaactatgggatttttttcttcattattattgtgattttgtttctctgcctttgatagggttgtagattgatccagagggattaaaactaacatatacctggttttaaacaaaagtgtatttgacccatagtactccttgttatatatttggatctgaaacatcttttggatagttttcttcccaatgggtattagattttcctcagactgctttctaagagacagaagctcagctctcttgcttgcttacccatattcttgcatacacacacgcacacacacacacacacacacacagagagagagagagag

SEQ ID NO: 14253 - DNA, 1104 bp, Homo sapiens
gatttttctttactgtttttctgttttttatttcattagtttctgctcatatctttattatttctttcctgtgcttgttctgtatttaatttgcccttctttttctaatttcttgtgcctttggaattatgccatctttcccttcttggtgttgagtgacattatatttgcactttgaaattggccgtggtgggagtatttacaccatgaaaatcagcacatattacaaattggtgttctctctttatcctaagagccagtcgttaaacggctactagcacgctacttgtaatggcaaaaacacagcttttaaaaattttctcaggggacctaacattagaaaaaactccaataaaaagttaagtcagaaaaggaaagaacttattagtttaaaatatgatttacagtatagattttaaaatctaaaactgtaaaggagattgtgcactgtttgatcctgaagacataaagaacaggataggtagacaccatctgtgatttcagtatagtcctttttgaggaaaagtgccttgatgagatgatctgcgaagtccattgcagttctgtgaatctatggtaagttatttcccagaagatggtaggaaagctattttattgctaatgaaaagctgatgagagagttattgctaagggattgatccattgccttcttaagaagctttgagattcccagacctaatggatggaaaagagcagaaataacagagttaagaaagctagagtctaaaattcgtaagaaacattagatgctttgacataggctgtcacttaggttttgtggatgcacttctaaacaaagtgttaggggaattcttggccaattcctctctcagtgtgctgagagcttagttcaatgtgttggtattaaatagagcttccattaattgatcagaaaagtgcttgttgtatttcactaggagatattggaaaagcccattttaaagttaatttctgtgctgccataactctttgataccattgatcttcttgtattgtagttattatgatgtctgtcttctagccctagactgtgagttggtactctatggtatttatttttgtgtttgcttaataaatttaggt

SEQ ID NO: 14254 - DNA, 1166 bp, Homo sapiens
acataggactgcttttatattattctggttttgtagttgggagaatagggattgagaggtgagatgacttgtccaaagtcccacaggtgggaagtcatggaatccttcttcaagacactttcatcccattatgcattatctcaggcaaaaacaacaaaactccataaatcagccatgtaagatctagatcttgtattggctcctcattaaagttggatggcttgacatttttctgagggatgactgtcagtgtactattagctaaaaacaaattattgagcacttgtactttatagagtactgaattaaaattctgaggagtggggagctctagggtgcaaggaagctcaaaccttgtatgttttcacagaggttggtaatgaactggggggaaattggcagaaacataaacaacaggtgagtgtaaatgtgcaagtcaggtaaggagagggcagagaagtctctagagcttgagtcaggctcacgggtcctggttggaaagttggctcttggaagtaataggttttcacattcttttccagtggttagggcatttttttgaaaagcctctcctgtgtggttaaggtactcaaactggctgaaagatacaagagaatgggtctagtagagaaggtgctgcttatagattttattctggggacctggtcaatggaacaggattacctgcactgggagcaggagagcaggctggctgaggaagcaattgcagtttggctgacaatttgactgaaaggttgcttccttatggtgagttggtggcagaattattgctttgctgtgccctatagacatgaatctaaatggaataaccaaatactgggtgatatgggtgggccaggtgcacaggccaagcctgtgtgtcctgcatcactggcagttgtagatttaaaagagaagactgccactgccctataggggattctccgtgttcatctcagtaactcctattccttgtaggatgagaaagtgaaagcaaagctgaggtcttcttgtacacctcaaacataaaagaacttctgtcctgaatttgttttggtaccatgaacccaaatactaccaggaagccaatcccacccaggaaaacagccacaaatatatcccattctaagaaatgttaaaaatggcatctggaactgtaagacacc

SEQ ID NO: 14255 - DNA, 1147 bp, Homo sapiens
aaacttgcaccccgctgccgcagcttcaacggagaaatcccttgccccaagcacacgtcagccctgcccgcggagtcatggcacagcaaaagagaggctctccatggagatatgctccagaagggtgggtggctgtgcctaaaggtttgttagaaaaggacagtcagtgaggcttgctggctgtggcgccttacgacgctctccccgacccctcgtcattcagaaggttccgcaggtctcgacagcggtgcgcttgtcagccccatccggcggccagcctcccttgccggatcgcccacgttgtcggcctggtccgagttcttcatttcaaagcatctgcacctgcgagcccgcggccagaggcgctgggggcgtttgtgcgcgtgtattctgaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggtaagtgctgcacctctgccggctccaccgcggctcccacttcagaactaatttgtgagtcttggaaaggtggggcaaccctcattgcaagcgcttgccaatttcagggggcactgaccagcctttggcccttttgctgattttctaatttaccaaccccagagggaacttgtaattaggaacgaggcaaaggaatttgagggcaggtagccttttccgtagacaaacaatgactatcctgagtgtcaagaagtgaggttacagagaatgaaacttactcctcttgccttcaaagtagcatcctatcccaagggaatctaggttgctaagagttccgtatctatcttggagtggacctcattatcgagtctactttcgagtcctccccgcccccacattaaaaaaaaa

SEQ ID NO: 14256 - DNA, 1326 bp, Homo sapiens
gagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatcacctgttgttttggagcaaattcatttgaatgtctg

SEQ ID NO: 14257 - DNA, 1160 bp, Homo sapiens
tgagaagtcaccatgagtgaaccaagagccctcactacacaccatatctgttagcaccttgatctttgatgtcctcacctccagaactgtgagaaattgatttctgtttataagtcactctgttttttgtattttgttatagcgacttgaacggactaatacagtcttctttcgcctctaaagttcagtgatcttgggaaatgcttctaggggtgggaaagagaaatgattttggctctatctggctccatgtctttctttgaaagttggctgggtacttgatcagatgtagttacccagatttagatggagttcttaaaacacctcagtaacatacaggaggatcttttccatagaccatcctcgtgaaagggaaaattacaaacccaacagggggtgggaccacaattgtcttgtttatccttttatcccatgaaacaaatgcttctggcacgtggtgtttttttaattaattttacttttgtgccctatttaagatgttttaatagttgggtataggtggatgtagatgctttaaaaaacctttatttattaagatagccagttggacagttagccagatttacagaggtaacataagttcatgttaaaggcaaatattccttgcccctttgtgtttcaattttttaatatatttttcttcaagaaaaatgatgcagtatatttatgtcccaagaagttatcaatttcactagtatctgagattgagatgtctgacttgagttttctctttggacagctatcacaaccagattctttttattttttttttttttttttgagactgagtctcactctgtctgccaggctggagtgcagtggcgcaatctcggctgactgcaagctccgcctcccgggttcacgccattctcctgcctcagcctaccgagtagctgggactacaggcgcccaccaccacgccctgctaattttttgtatttttagtagagatgggttttcaccgtgttagccaggatggtctcgatctcctgacctcgtgatctgcctgcttcagcctcccaaagtgctgggattacaggcgtgaaccaccgtgcccggcccacaaccagattctttcatatttatttctcgttatgtgtttaaatcccaggattattctaagcccgctaatattttca

SEQ ID NO: 14258 - DNA, 1178 bp, Homo sapiens
ggacactgggacatgtagtgagaagtgggcagatcttaacccttcccccacatacctttttgagaaagctttgagccaggaattagccttaacaaggcatctatcttatctgggtagaattttctctactagaaaatgttgaagagaaatcttggacattttgaagattaaattcccaccaccatcctcttctcctttctttgttttttttttttttctttttctatcatcttatatcccctgcccctttcttgaacatcgacaaaaaagtttggataagttttagtgaaatatcctttttacctaaggctaatcacttatttcacctgatatctcagggatttgttaggtttattgattataggtttctgatttcaaccaacgaagttaaaaggaaattggtgattcaggtgttctattcaggaaatgtgtgcagatattttatttagtttcaccatagatttagaaataaatgcatcgcagtttactattttacaaatatgtaggaatctgtataaaatgctgatgttttctttagaatttgcatttatcctttttgcaggtgtgaatggaaacagatgctctgaatcatcaactcttcttgagaaatacaaaattggaaaggtcattggtgatggcaattttgcagtagtcaaagagtgtatagacaggtgagtggacagtgaggataattaatgaataatgaaaatgataaataatgaaaactgtatcatctacagatacagttttccttggagtttattcttaattttaaaaaggcccttctggaaagtctctttcattttccctgagtctgcccttgggaccagccatttctttccttttgttgtttgtttgtttgtttatttatttatttatttatttatttaaaaaaaaggcagggtctcactctgttacccaggctagagtgcagtggcaccatcatagttcactgcagcctcaatctgcagggtgccagtgattctcccacctcagcctcccagctaatttttaaatttttaatagagacagggtcttgctttgttgccaggctggtcctaggctccttgcttcaaacagtcctcctgtcttggcctactgaagtgctggaattacaggcatgagtgactgtatccagcagggatcagccattttgcatgcccacaggaaaaaaatat

SEQ ID NO: 14259 - DNA, 1233 bp, Homo sapiens
gattaattattcacaggacatgcgggtaacttttcaatctgtgacagagagctttatttggaagagtaaactctccaagactgagcacccttgtaaggtttgcttattgtctcagaattcttttgagcttaaggtctgggcttgggctgaaggggtgagaacccaggcacagcccaaagcgagagaagacgacagacatccagtgtgtcctgggctgccagcctgggtcagggtaggagcagaggccaaggacagccccttcccccggtgggttcccgaaaccattactctcctgtgaggcttctgttagaagcttggcgttatttctcctcttctgtttctgaggcccgtgcatgctctgttgtgctctctgctcgtggcagctgggacccgagcctgggcccgggtaatgtgttgtctctgctgtttcctcctcagaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaattt

SEQ ID NO: 14260 - DNA, 1510 bp, Homo sapiens
gtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgcttgcatagtagtgatgaccattatttcaagatatactaacagttttttggtttttttttttttttttttttttgccttttagtgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaacattctttttttaaaaataatctgacagcttggtggattagacagtaaatttgacagctggtaaacttttctgacccagacaaattggatataaacatactactatgcacctttactgtgaagctgaaatggggcggagaagctgttaccaagtgggcatttagtgctatccacctatagtcactcattcattcagtttctacctcttctcaagccttttcagttttctcatttcttgcttagctgataaccttgcttcctttaatcactaaaaaagtttaaagcagagaaaagaaccccacaaatttctgttacctatattctgccacctatgcatgtgttaatcatactaccttctgtcataccactggatggattgtgctaagacataagacagccttttttttttttgcccaatcagcctcatggcttcagcaattcacacctttatcaattcctcgctgtcccttgtatactagtatacaaatactagtataccctcccagagcaccttactaagtccctttatag

SEQ ID NO: 14261 - DNA, 1510 bp, Homo sapiens; identical to SEQ ID NO: 14260

SEQ ID NO: 14262 - DNA, 1283 bp, Homo sapiens
cccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccctttctcatactagactgagttttttgagaatggaggtggtatcttttttttttttttttttgagacaggatttaattccctttgaccaggctggagtgcaatgcaatgttggctcactgcagcctctgcctcctgggctcaagtgattctcctgccacagcctcctgagtagctgggactacaggcgcacaccaccgtgcccagctaatttctggtatttttttttctttttgtagagacagggtttcgccatgttgcccaggctggtttcaaacacctgggctcaag

SEQ ID NO: 14263 - DNA, 1099 bp, Homo sapiens
cctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtgagtgaaaaatcagcagtggaggggaatctaaactcatgatagggtattttaaatggcacttgctgttttagtttctggtacataagttattgaggtgtgtgtatacaagtatgtgcacat

SEQ ID NO: 14264 - DNA, 1132 bp, Homo sapiens
gtaattgctaattaccagccctgtatttactgaaatggctgtctgtcatgcttgccatttttatgaaacactttattgcaggtcagctattattgcacgtgctacttcaagtcactggctcaggctggtgtcatgtgtggtttgctgcaaacggcagcctgctttgcagtgtgagctcttcctggaaacagcagtctcttgtagctgatgccacatcagctttaagtcattaggaagatattctaggccccttgttgcttcagccatcagtctataaataacacaacactaattttccatcaagtaacagcttaaaacagaacactgtcaaaccactttatgttccacccttaaatcacatcactgaggaaacactgtaagagaatgcagttgactctttcccccccttctttttgaatgaacctcgtaaacctaatgctttagaaagagctctcagaagactgagaatggtttttaggataattttgcctcagtaaatcctctctacattcaggcatttattaggccattacttgttttgggactacagattatcctggcagctcaataactggataaacaggactttagtgaaagattttcagaggttctttagggaaaagaatgaccaggagaaggtgggtggaagccttcagttctttgacctcttgcacgtagaatcctaaaactgatcatgattttagctaggactgacctttcctagcttgtagggtcactgtgaattttgttcatgtcttaaaaggtttaagttaacctagttcactgttacctacacaagtaacaagacggccaataggacctgtcagcatgacttcgacatgcattccaggcatctttcggggagtttagatttactgtgtcatttcagaacccaacaaaggtgatggaagctcttaggccagattaaatttcatggaacggaggctgcagaagtctgtgctgcttagtgtgtcagctgactttttactgggacaagtctatgaaaggcccacctgtaacaaggcccctttttgccctgtggatattttaaaagagggaatttggtgttgacaatcttacttacacgactcttgctaagctatttgactaagggtttcaatcagatgcttcc

SEQ ID NO: 14265 - DNA, 1895 bp, Homo sapiens
acagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttagtatgcctgtttcttccactgaagtaataatccttcattataagtatttaggatttgtctataatatttaaataagcaaaatcttggtttctttgcatcctgctgtgtgacatagaaatcaatacttcaagcctgttttataccgcgaaagtaaggataatgtgctgcaactgcaaattttatttctctcctagactatgaaggaggacactccactgtgctcatctctgtagattgcattggggtgtataaatatgaaatctggttccctcaaagaatccacaaaacttttgtgataattacaactagaagccttataaataacaaattcattttgaaattttgaccacatattaagtgcttaccctcgatactttctgttcattctctcttaagctcccactatccctgagaagtaggca

SEQ ID NO: 14266 - DNA, 1197 bp, Homo sapiens
ttattggtcaaaggaattaaactataaatcttcatgctaaaaattattaaaagggattagtgttgtttactatggtttttgtgcatgtctttataaagtcttataacttttaaaattgaaatgttctatattgtttactaaagaacattttaatgccttggtggcatcaatacttttttgcaatcattaatgatatttagaaagtagacatataacatgaaagtagaacataatatagattgtacaaatcttgttttttaccctattttcccctgcagaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaagtgagtatattcaatatattgttaacctgagaaactttacatatctattttaattgtaatgaaactttcctcacagtctttgtattactaaaaattaatcttaagatgtgtaataataaaatgaactagttttttgtcttacagaaggtaatggaaagtattacaagtagaaatactgataatgggacaatctgagtacaaatggagggaaagtaattgagcctattactatgaaaaattattaacatcaaattttcgtctaaaccttgcgtcccgggcagggattagtagcttgtgtggggtgtagaggtttcgggtgaaacatgatttgtgtaaatcaagtaatgaa

SEQ ID NO: 14267 - DNA, 1175 bp, Homo sapiens
tgcagaatcagtaatagtggaaatcatgaataaatcaaagctcacaagagtgaagtgtacttggtaccagggttttgttttaatgggggtataaatctttgcacatatgtattcatctttctagatttttgttgttgagatgaaatagatttaattccccaaatttagccagttagtaagatcctgtattattgagagatcctgtattattatttattttttagttggtattggtgaatgattttggtaacagttgtttaaagggttaaagtattaaagatacagaaaagtgataattacctttgaaggtaaatcaaaaaagctgaagtcccagttacagccacactacatcatttgctattttactttgaaaatttacatatcatttgttatatatattatacacatcccatgtagtgctatggtttatttcttatgcaagattaagaaactgtaataactagaacaatagagctcctattcctggggtcaagacatggaagtacagtggtcttcttttattttacactttattttagaatcccttatgccttggacggtagagatacagtctttgtttaaaatggtgattgaactggataacctattaaaatgccttccaactcagcaagtaacttgtagattagtgatttctatattgaatttaataatggagatattatggtgttcagaacatctgagtctctaataagaaactattttaacttctctgggcttcattaatcttaccgtttaatgtgacagtttagttgatttccatcatcccttctggttttaaattttataatttaacagatttaaagagaaaaatatctctcattttgaaagttaacaacaatctatttagtttaggtctattgcatgtttgaattttaatgtgagatccagttcaagttaaggtatattttatactgttagaactcgtgacagtttctatgtcagaatttagtacatctggaatatgaccagttattactaatagtaaagaaagtagacatgtctttcttattaggaaatttaattatgtacttaatgcatgtattttttccagagaactggggaagagtgtaattgaaataaaagtacattatagacattaaaatattctcagctaaacatggaaggactttaatattttttcagttttagaaacc

SEQ ID NO: 14268 - DNA, 1465 bp, Homo sapiens
tctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaatcgtttctctggaccttcatagtttaagaagtaactatttggaaattctgaagacacataatttgcgttttctgaaccttaaaaaaaaaggtacttctgtcacttataattgttttagctcagtaagctattttttttcaatgtgaatctcttttgagagctgaacatgtccattcttaaccacatttcaataacagttactgtagctaaggagctaaatagtttcatggattaatttttttcagaataaatttaaaatatccatgattctgatagtgggcacatgaccaaaagaaaaaagtaaatcaatatatttagccaatggtacatttactttgttag

SEQ ID NO: 14269 - DNA, 1160 bp, Homo sapiens
ctaacccatgttcagcatattactataacttctcctataacattctgacttcctatttgtttacaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagaga

SEQ ID NO: 14270 - DNA, 1090 bp, Homo sapiens
attattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagcct

SEQ ID NO: 14271 - DNA, 1199 bp, Homo sapiens
aattctgtatgggagatttgtcggttctcatttatttatatcttgtgagctcatggatatttatactttgggttataatccaatattaggtttgccctgctgttttaatgtcatttatccttaatcttatttatgaagttattaacatttgtttacacatttttcaaattttattatgattttaattttaataactaccccacgataccagcttaatgaaggtcaggtggacttaaagttaatagaagagcaccatttatcagttccacaaaatgaatgcattgtctcttaagaacccatacagaggagtcactactaactttggacttgagaaataatttgcctgtaagacagtcttagcatgttccccaaatgtaaaggaagcgctgatgtctatcactggacagaaagaatctaaagagtgaggaggtctctgttttactggcaagactgcccaaggtggggctggaacgggaccagtgtgaattctgggcagcaggcttcctagagcagcttgcctgttacctcaaagtctgggaaagctttcagggtaattggcctcattgaagattttgtttatgttattctgccttcatcttctgtggatgctatgtaattgtatttggtcgaaagccaaaaaagcaatatttgagaaatgttcttccctctttcctcttcatccccatttttccctgggtattctcaaatatcaacagtaatatgttcctttgctgagaaagatcgtttttgggaattcagtgatgagagcaaaggggaactgacttcagctcttactagaactgaatgccctgggaagcatgtctggctctctgtatatatctctctctggtaagcctttttttgagttatatttgaatagcagaagtttaagcattgacaatgtatgagtagtatattcaggttttaaaatgcgtacaaaaatcataaatactgtctaggtacaatgtctatgaaagttttttttttggtggttttttgtttttaaaatgtacttttatctgattagtagtaacagcagcaaaatgtgttctcctgaaatagttttaacaccagtgaaaggtggatcttgggagccagaacatgaagagaatctcattgtcctgtcagcaacatactggaagatacaattgcagacaagaacaacttaatctttggggacactcgcttttggcagtgaa

SEQ ID NO: 14272 - DNA, 1194 bp, Homo sapiens
acgcatgccccatgtcccgacacaggccagcacacttagctggtttctatctccaccctctctttttcattcccttgacacgtgtgtgttgcttttggtcttactgaagagtcttcccattcatgtatcaatattttgaaactcttagtggatatcttattaaaagagagggggaaaatcacctatgaatctctggtgcaatagagtagcctcagtcttcttgatataagttatttgttaattctagaatcattattagatcatgcttatgtagttggtgttggccctcttagcccctaattgctcctgccataggcagagtagacggcccatcccctattatttctcaaagtgcaaccattagtttccatgaactcctcctttcttgctagatgagcagaggtagctgaaggtgaacctggccctactcctcctgtcacctctctctttctgttagaaatgcatgaggttgacagttgtttcagggaaacatgactcctttcacttcctccagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggtgagtcctgagcagagccccaggcactctcggtggcccttccctctgccctcccacgtacccagtccacacagtctcgatctgccttcaggagtgcagaggacagatgggacagtggccttgacctttgctttggacttactcactttctttttctttcctccctcccccttcccctccatccttgtcataatcatcatcattgtttgttagtgtctgtcttggaaatagttcagagagcttctgtatttagtttgtcatttgtacattcttaatgacaccgcatttgccattgtgatgtttcttaggtgtggacttctatggcactaagtgcatcacattgtgcagccatcacaactgtccatctccagtattttttatcttgcaaaactgaaactgtacccatgaaacaataactctgcattgctccctccctgtaacccctgctcacccctcttctactttctgtgtctataaatctgcctactctggct

SEQ ID NO: 14273 - DNA, 1191 bp, Homo sapiens
tgcttgtatctggaggtaaaataagatttttataataaatatgtttagtctgttattttttcttttaatgatgaataaacatttgtaatgcttctaagctgtcacacttaagtattatagcagcacttgcctggttagggcatatttgcatgttattatgtgtgttcatgcatattcatattacatgtagtatatttcatagcttagtcctctttgagttcccatctaatgaatctcagggatttatgctgggaattgcttaaaattttgtttattattctggaattggatgtcagattttcaggtgctttttaagatctataagttctgaacccagcccaaatgaaagtagacaaaccaatattaagagaaggtggagtgcctgtgtcttatgtatttttataaccgtagtattcccatgcttgggctaatgatgcttcataaatgtttgtcaagctgtactgctgaggggataccaggtgtaactagatttttccctttaagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccgtaagttctgtgtttcacattcgttaagtaaaacagctataccaatttggcagcatattctcatttaattatcagaaggaaaaataatctttatagtatttaagatatctgtcttcttgaatagtgtccatttatatatttctatattgtttcactgatgccagtgaatccatggatggctttaattttatcccaacttcctttgttatagttgctgggaaatgttgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagaca

SEQ ID NO: 14274 - DNA, 1138 bp, Homo sapiens
aggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattatttttcattttattaatgccattattttgtaaatacattttacaattttgcctatttgctaccattataaattttcactgactcctcatagacagcatattcttaaat

SEQ ID NO: 14275 - DNA, 1143 bp, Homo sapiens
tatggcagagtgtgcccgatgagtatctgttgaaaggttctggaggtagttagtatcttattaaagaaagactatgctgttaactctaacaacaggccatcttttaagatatctttttggtcttggagcttgcacactacttgacttcttaaataggaagatagcttgttcatgtattggtagtgatggttgtgccaatcagagtaccacgttttactcttgataaagattatgttaccaagtgagcaggtaccaggcaaatggataggtttcctagaactggttactcttttaagtgtcattgctgtgcatagccttacattttctgaagatggggactgtcatgtgatgcagaccaaggactcttgaaaatgttgcatagatgacaagcctccaaaatctgtgtactttctatattttacctgtggctcaaggataacttgcacaggctagaactcagcaacatgtgtggtatgaggaatgttagagttggaaagaccccaggaacttatcctcactgatgtgcagattgaggcctagagagcagaagttgacttgactttgtcaaggccactagacagccactattaaactgctaatgtggtgatacatttttccttatgtgagaaccaattaggaaaatggaatcctggtttcaaaattcacatactttttataaaagcatttctttattatgttagtggattgcatggttttcagattgggagatgaggtaagaatctgttgcttcggaaatatttacgggaacagtaagggaaacaatctcataataatcacattagtcaaatggaatggtatatatatatcactatatatatactgtatatatatgtactatatatacagtatatatagtatcactatatatatactgttatatatatatcactatatatatatatagtgataacttctgtttctgtaggcatctgacaaattggcaaataactggaaatactacctttataatggttaccattatgttagaactgtactttaagcaagtatatagatgaaggatgtttattttaatattttggcttattcagtgatggtgatgaataatatggctgacattggcatgcttggttccacaaggaaactttctggtaataattttaa

SEQ ID NO: 14276 - DNA, 5236 bp, Homo sapiens
tggaggacattatgttacatgaaataagctgggcacaggaagacaaggcatgatctcacttacatgtggtttctaaaaagttgaccttgaagtagagaatggaatggtggatttcaggggttgggtagatgttgatcacgagagacctaatttcagttagaaagggggaataaatttaagagatctattgtataacataatgactatagttagtagcaatgtgttgtgttcttgaaattgcaaaaaagaaaaattacagtaaaggggaacttggtaattcatgattgatctgctaccataattataccaaccttctttttatcatttgtctatttggttgttttgcatactgacaagattttcttttcttttagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaagtatgtgtaaattttcttaatcttgttattcttcatacagacaagtcctgttctttaggatttggggaagaaaacactaagtaggaagtgaagcttaaaaagtactattagcgtccatgtctgaggcagtaacgcagtttcgtaaaggttaggctgtgcgaggtggaattacttatggtactaaggtttatctatagagaaatggactcccctagctttacccatcctctcattctccttcactctaagatgatttgattgagaaaggaaggccgtagtcaaccaaccttaggtagcttcattgcctggtgacaaaaaagttatgcatagaccgggcgcagtggctcacgcctgtaatcccagcactttgggaggctgaggcgggtgaatcacgagatcaggagatcgagaccatcttggctaacgcggtgaaaccccgtctctactaaaaatacaaaaaataagccgggtgtgatggtgggcgcctgtagtcccagctactcgggaggctgaggcagtagaatggcatgaactcagaaggtggagcttgcagtgagccgagatcacgccactgcactccatcctgggcgacagagtgagactctgcctcaaacaaacaaacaaacaaacaaacaaacaaaaaaatgcataatttttgggcctgagtgcttgggaaggcagcagatttgaagattcagtgttttgggcacatgggtgatagtgtggtcaaaatatgccatttcatactgcttattacactttgtaatgaatcatacttttgtttagtgataatggttctcccaatagactgcaggctctatgagttcaagaactgtatgttttcaccattttgtttttggcatctaatacagttattgagtaagaactcagtaagtatttgtttaataaataggcaaataagcaataatcacaagagcaacattttttaaacgatttattaagaaaaaattaactttttaaaaaatatttaaaatgtttactttcatgtttaataaaaacttgaaatatgctaataaactatatgcagaaaatatttaacatagcaagtgtgagactgctatctttagaaaggtctgcctgcaagagtagcacttgtttggagtctgggaacttgacacttgtaccatttcctaaatagtaatggtgatttactatgcctagcctatttgtacaaacatgaatgtgtgctctcttttggggagtctggaattttggtacatgctaggtagagtgtgcccaataaataccttgggtgctgagtctctaattggctctcctgggcagaaatactgtgtacatgttgctgcatttttgttgctgggggaagtgtgtgttctgtagcacttcatgggacggagaaagcataaggaagcctgcacatggatttttccagactctgcctgtgtctttcccgtcatctcgctgtgtatccttaccactgtgatccaaccacatactgatttgtgtgagctctagggttctctgaacatgaaagcaatcttggtaacctttgacacaaagtgatatatttgctgaaaattttccattagggtagaacaaatctactgggaatcattggtctgtattcagcagacattattgagtaactaatatgtactatgtgtacatgcacatagttataaggatgtaaaacaatacagttggtgtacttaaggagatcattgctggaaggggcagatcataatgccatatgttatgtaggcagagtcaagatactatgggagaaaaattaggacatacagcttagggatttcagtgacagttttataggggaggtatcatttgaaccgattttctgaatgttagcagggatcaggcagtgaaaataggttggattcagatggtgaaaagcctgaagcgtttggagttgcggagacgggtggggagcgacaaacaggagagagacatgactagagtcatgcactacaaagttgtcttacgtacgtatccattagtaagcattgctaaaggcatccatgtctcagtcactaatagccattttccttttttgtagttattaagaaatttatgattcagggtggagacttctcaaatcagaatgggacaggtggagaaagtatttatggtgaaaaatttgaagatgaaaatttccattacaaggtaaagtagagaaaatgcatgttattgctgataaaaagattgttatatatctggaatacttgttggattaagacaccaaaaaatgtttcaagtgtgcttagattctccatttcttgtaataggaatcacttttgtaaataatggttctttaatatggaaaagttttcattcagtaatgattaattcagcattatttcattgtgatccagtttttatatgcttcagttaagccagtgagtttttaaatgcgaccagcatctggcaaaattgtttccaggaaaaatgtttccattgttggaaggatggtaacttgtgcatccttatccttgaatttgaagagcaacaaaaccatcactaatatccaggatgtcaggggatttgcacactagcagatatagttaaatgtccaagctcctaaaggacttcagtggtgcctgtgccttcttgtcttcgttgtcccaagatgtaattggggtatattgcatcattcaagttataagaatggacatgtaagtacaaaagtaaagtgatatttttggaaataaggaatatgagcaagggtattaggataatttgaaaaaatgtcgtcagtcttccagtcagtgtttattgagccactatcactggcaccaaagggtttataaaaatgaaaggccttgatgacaaggaatttataatcctacctcagagacaagattaagatacatgggactactggagaataatagtatataaataaatgctaaattgattgaatatccttgcttgtataacattgctaatactgtctatatactgcaggagaaagatgtgatttatgcagtctgaattattatggaagtcattgaggaggaatggctacttgggctgtgcagactgggtcttgcaaggcggcaacatgtctgagatttggttaggcaggaactgtagtattgatgcagaatttaaaaagggacgtcggtgaggaaagacaaaggcaagagacgttgaggaaataaagttctagttactgttgtaccaaaggaagctaccagaaggatgaaaactaaaggtgatgtgatgatcacattgacatagagaaaaggggcctatagacaagacacatgattcttgctttctataaacgtggtggccttaaaatctgaatttgatttagactgaggggagtaaaaggcattttggtggggtggggggtgtcatgaaacattatataacatgagagttacggtgcatgcaccaacaaggaatacatttagaaagcctaggagataaagtgaaaaggttaagaaattgggtttcatagatcctttgacaggattatgccaaggtagaattttgatttcaagatgtatgcagcagtttcttttgagcactctccgaagaggtgattcatctgggatgaaaacctaatccaaatcctgtatgatttggattcttttgagattaggaaagtaccaaactgaatgtcttgggtaaattcagtatcccattattgttccagtttattgatgttttgtaaaggaagacttatactgtaggcatatttatgaatttggaagaccgttcaggtcttcccagaaaaaaagagcattcatcataaagagggcaaaatatattacaagagtttcataatgctgcatcttcattttaaaggtgaagtgtaagtattttctcatggccaatttagaaataaccctccccccgactattgtttctgttacctatttactttgataaggttttttaaagtttaaagtgattaagtgccccatgttttgtgaattaaaggttgcagtttataaaaaaataaaaagtaattaaaaaattttataagtgaaaagtaaaaaaaagtagtttgatctaaatggtagtatagtgcaccccagttttatgttcagtaaaagaacagttcagactaacacacaattcagaaaagaacacatctaaccttggttttcttttaatttttatttctacagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaagtaagtaaaaagttacagtgaaatacacttattatcttagttgctatctttttgagacggagtctcgatctgttccaggctggagtgcagtggtgcggtctcggctcactgcagcctctgtctcccaggttcaagctattctcctgcctcagccttctgagtagcagggattacaggcgcgcgctacaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctgg

SEQ ID NO: 14277 - DNA, 1177 bp, Homo sapiens
tgtgactcactgatgcatggcaacttttcaaacttatatttccctccaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggtaataaggatgtaatccaaagtcaaatagagaagtgattgtggggctttgaagatggcagaatttctttgccgatgtatcagatgtctttcctaaggaagttaaatcacctgtagcagtgataaattttaggcatgttgatgttagttaccagatactgggttaccttagggaaggaaatgactgctttttcgtgactgaaggcattattaccttgagtgttgttaattgattacataattttttttattaatacagcccagtagataagttataaaatttcttctcagtaatttgacttgctttctcttcaataaaggctatgatctcctgtaggaaaatagcagaatcaagtctccgagtccagttttatgtcagccgtttgatggaagctctgggagaattcaggtaaagtggcaaagtttggcaaatccaacaggagatgtttatgagcagccatggataaagataaactgtgacttggaagaattgggggcctggcagttattcctcacttttgtggttccgcccttcaagatggaaacagaacaaatgaagcaaaaaatttaaataatttaccgctgagtaatcctcactattgctcaaccgacagtccctgataggattgtttttaacaggatgaatggggaaaactaatgttcaggtatctctcaccagtctattcattatcttatgtcagcctcacaaaagccctaagcactactaaccccattttacagatgtggaaacttgagttcagggatgcttattcaaagcacagatggagaggttatgcatgtcgggaagacatacattccagtttgccaggacagtcctagtttacaccaagtgtcctctggaaactggtgtctagagtccttgctcctagtatctgtgtggaaaggtaaattgtgttgggtagcagg

SEQ ID NO: 14278 - DNA, 1203 bp, Homo sapiens
ggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtaactccagcaggctgggaagtagagggaactgggttcaaatcccactttcctggcctgacacctgtgatgttgttagccactactattgtctgctttacacacagtatctttttttccacaaagtactagaagtattattaattctatacaaacggtttcccacctgtccttcttccaaggatggtcactggcttagcaccactgagctcactgggacaggtggccagtggttgtctttgcagctatcgtgatcctttggggaagcctaagggatgtggtggagatgggggagggaatagggagtttaattttctgtcaactgcagagaaggtccgtggctggcagcagatgccttgcttcagaggtggtggattacactcgccgtgtggcctctctcctgccgatcagagcagcgtgaggtggttgggaaacaacacctctttcttaacactccatcaggttgattatttggtctgtaatgactgaaagcagtaattagaaatt

SEQ ID NO: 14279 - DNA, 3542 bp, Homo sapiens
aatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttcctggtgctgcatgcga

SEQ ID NO: 14280 - DNA, 1233 bp, Homo sapiens
tactgataatttggaagtcattggatgttattgacagggtagaaagttcttacatggttctttttcttaacaagatctagttaatgctacttggtaatggttaaggaatggggtaaatataacccaaattagagtgaacttcaaggtaagtgtgattttttcttatttgtataaaatctataatatgggtttctcctaaatcctttgtttatatttctttagcagtgtttggcgtattataacctgccataattgtgtttcaacatacaagatagtgtggataacgaaatttctgtattacaattatgagttttaagatgtgtaggttgtaggcatggagccaggctgagagagagatcatgccaagtcttagcacagaaaagcatcagtgcctaaggatgtgtgattttacttcatctataaggtttcccggttaggttagtttccttcttgagataagtcacacattttccagagagaggcaagcaattggtaacctacatatataaagtcagataccatcagcatgggggtaatttgacttaaccttgagaggagtgttttggcacatggatatgtgttttgtgggacacgggccagatggaaggtgtagaacttgattgtttaatccctgagttgccatttactttttttaaattgtgataaaatataagtaacattaaaatttacaattttacacattattaagtgtaaaaggccagtgggattaaatacattcccattgtttttgcaaccattaccgccatccatctccagaacttttttgatcttcccaagttaaaactctgtgccatcaaacaataactccccaatccctccttcccccagcacctgtcaccctccattctactttgtgcctacgtgaatttgactatttgactactctggtatctagagtagagcattatatattatttgtccttttgtgactgtcttatttctagcttgatgttttcaagttttatccatggtgtagcatgtaatagaaattcattcctttttaaggctgaataatgcatataccacacttgtatgaatatcattcatacatttttatctgtcgatgaacacttgggttgcttctaccgtttggcaacagtttacttttaagtcgttagttatatctattacagaaaaatatttggacttttgacagaaactagtctagaggattaaatggggtctttctagtgccctttcccagtcagtgga

SEQ ID NO: 14281 - DNA, 1133 bp, Homo sapiens
tattgtccttcagaatctttaaagcagcttctcttcctcttcctccaactattcatagttagcctttgtttgaccctcactgctttgagaatcagtgttggaataagccttggttactcatagaggattgctgacattcctcaggtaaactgaggagaaaataattcatattgatatctctgccattaaacctgtaaaatctgtgaaaagggaatgcctcatagtcatttttatgtccttcgcacatggaacaacttctgatctacagttggcgtgaaataagcattttttttaaactgagttttgtgaaaactgcaaatattatgaaaacaaaaatcaaaagagctgtccatctgctttccactgcacaccatagccttggcttctcattccagttccctaatcctaatatttctacttgctcaacttttgtgtttttcttaggagcttcccacatcttttgaaataaggtaaaagacacataactgtattgcaaaattaaaggttgaactcatgtcctttactttattattttctgtacttttaagttatgagcacttaatagaattgtgatgaatacttttttgactcccatccccaccccactcagggataagggatcagatgcatcatggaagaatgatcaggaaccaccaccagaggtaagtataagtctttttatgcaacattttataaagtagggcaggacttaatcttataaattttatcattcttgctgttagggaagtcattaatactggctagcagccatactgccttatcctgtcctagcgcatgtattctctcaccgtcctagatgactatttcatacctttcagtgaaaggttttgattgatcatttaggaaaaaaacttttttcagttacatttagttgtattttaataattatcaccttatcatttacattgtagtttactatttttgtcaactttgttgatgtctgataaaggcaggctgtcattattttttaaaaatttaattgagtttagtaaatacaccatatgggacatgaagacatggtgcttttaatagctgtccttcttttggaagtacagaatcattggaagcacaagatcattggaagctacctacctctctactttttacgatat

SEQ ID NO: 14282 - DNA, 1139 bp, Homo sapiens
ggcttcaagtggggagccaacaaacaaaatttaaactgagacagtggttgctgttaacgataatttctgtggaagataaggaccaagtgagttttcagaaagtagaatggtctacatactttcgtaactgaggatttcccaagttgtctgtagcctgagaagaaactcattaagcaatctggcaattaagcgatctggtggttgtgactaagagaggtgccatgcccagaattccctttttttagtggtttgtcacatgcttgcttatattcagacaggtgtatgatatgtgagagtattgtaataagaggatctgggttatggcaaaggtttgaaaatgttattggtaaactaaatactactttcccaataccatatcagttttgaagtgctagttttgaattagaacagcagtagtaaacatgtagtaaagttgatatttcttaattgcataatcttattttaatattagaataagcaatagtaaacttgtattaaagttgatatttcttaattgaataatcttattttaatattagtataataatactggactatttttttaactgttttcttccctacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgtaagtacttagatttattaagcttagtttgcatgttttaaaacgtattctggtaccagtattgatctaattttgcctatatctgctccataaatttgaaatttattctcagcctaataggcatgcttttggtatgccttggctttcttatgtaaaagagagtagtgatctggataatttcttaggttgcttctaactctgctgacctttgataattgttccgattatggcatcaacttcagctttgaactttacattttttacattccctagaagaagatatttcttatgtagatttgcttttttttttggtctgcacgtcagaaaattttgctcaatagcaattgaaatttcaatagcaattgaaatcaatttttttg

SEQ ID NO: 14283 - DNA, 1816 bp, Homo sapiens
agtgctatgatgacatgggtacctgcatgaaggccatgaccaagcagggcaccgagctgtcctatgaggagtgcaacctgctttccgtggcctacatgagtgcggttgggggctgcaggtccacctgcagggtcatcttaaacatcgagcagaagacagacacctccgacaagaagttgcagctgattaaggactaccaggagaaagtggagtctgagctgagatcgatcggcaccatggtcctggaattgttggataaatatttaacagccaatgcaactaatccagagagtggggtcttctatctgaaaatgaagggtgattacttccagtactttgctgaagctgcatgtggtaatgatcaaaaacaaatgatagataattcccaaggagcttaccaaaaggcatttgatataagcaagaaagagatacaatccacacatccaatctgcctggggcttgcggttaacttttctgtattttactatgagattcttaataacccagagcttgcctgcacgctggctaaaacggcttttgatgaggccattgcagaacttgatacactgaatgaagattcatccaaaagacagcaccctcattatggagtttcttagagacaacctaacactatggacctcagacagtgcaggagaagaatgtgatgcagcagaaggggctgaaactaaatccagacagggtgtcatccttcttcccttcaagaaacctttttacatatctccattccttattccacttggatttcctatagcaaagaaacccatttatgtatacggaatcatctgtttacagtcttttcacactgcagcattgggaaaacttcattccttgatttgtcttggccttcctagtgtgtagttactgctgtagaaaagtattaataccttcatttcatataaacataagcaacttccaaacacttaggtagaggactaaaaatgtatctggtatttaagtaatctgaaccagttctgcaagtgactgtgttttgtattactgtgaagatatgaaaatgtagttaattacaatttaaagagtgttccacacaacttctccatttctacattccctcccatactcgtcagggtttcctttcaataagcaacttttccatgctcctaatgtattcctttttagtaggaatccagaagtattaaattgaatggaaaagcccttgccatttctggctggaggtcacaaattgaaatgcctcctgtatcacatattatggaggtcatatatatctgtggcaacagggactttccttattcactctttatttgctgctgtttaagttgacaacctcccttcccaataaaaattcacttacacctcctgcctttgtagttctggtattcactttactgtgtaatgcaagtagcatgttgctgccagaatacaagcattgcttttgggaaattaaagtatatgtcatttcttaatacactgcaaaggggaaataaataaaagtacacaagtccaagtctaaagctttagtacttttccatgcagatatgtgcacatgtgtggggtgtacagtttgtctagtattgttatttagagatttggaccactaccgtgcactgctaatcattgactatagtcccaaaaaagccttgtgaaaatgatatgccctatgtaacagcagagcaacataaaatacaattatattttataaacaacaacaacaaaaaaccactacattatttgcttatccataagaaagcaactcctggctgaggcaggaggattgcttgaggccagtagtttcagacaaacctgggcaacatagaaa

SEQ ID NO: 14284 - DNA, 1115 bp, Homo sapiens
acctgtaatcctagctattcaggaggctggggcatgagaatcacttgaactcagaggcagaggttgcagtgagctgagaccgtgccactgcactccagcctgggcaacagagtgagactgtctcaaaaagtaaataaaataaaagtttaaattcagccttttaaagacacataggtgctgcatttctattggaaggtaagaatatataaagttgctttcagcactgataaacactgataaacttccataactcattattaaaaaaaaaattaggcatgtgtttattggtgtgctggatagtatttctttgatgtatttgtttctcccttgcctctcaaatatagatctctctagctaactttactggatctatcagaagaagaagaggagtgaaggaaagacacccagccacacaaaagaacttcatgatgccaacagcgtgattgcttagaagttcctacacaaaaaaaggatcatttgaaagcacctggaatggtttattagcttcacaggattttattcttcttggcttctatttggagggaaaataacataaattcaaaaggattccaatctgaagcccaaatcgtttgcctacataacaaaaatatctcatcttttcctgcacattattattcttttatgggttaaaaagaaaaataccttttagtgttttagaactctctcatggtaaaaagtgcaagaatttaaaatgttgctttcatattcctataattctccaaaagtattaaattcgtatatgtttgagtgattttctaaaaactgctcaacctgaaatcaattgcattgaccatttggcttcgcacaatagggagaaaataattggttcattgattatatagagagaaagactaagaaaagctattaattgctaccaattttatgataagctttaaggtttatgaaagtatgtttttttatttaatgagtaatgtccatttgaagttgaaagaaaacatgaaatcctaattgtagttcattttatgttcaaatgaaaccattgtttttgtttttgttttgaaacagagtctcactctgttgcccaaggtggagagaagtggcacgcttttgtctcactgcaacctccacctccc

SEQ ID NO: 14285 - DNA, 1555 bp, Homo sapiens
gcttgaacccagaatgcagagtttgcagtgagcagaaatcacgacactgcactccagcctgggcgaaagagtgaaaatccgtaaaaaaaaataaaaaaagaaaagaaagaaaatgcgctacatatacacaatggaatactatgcagccattaaaaggaatgggatcatgtcctttgcagggacatggatgaagctagaagccatcatcctcagcaaactaacacaggaacagaaaaccaaacaccacatattctcaatcaaaagtgggagttgaacaatgagaacacatggacacaggaggggaacaacacacatcagggccagtcagggggtgaggggcaagcaaagggagaacattaggacaaatacctaattcatacggggcttaaaacctagatgattggctcactctctttctgccaccatcttggttcctcgttccctgcacaaaatgccctgtgaagccacagaaaccgtccctgctacagagcaggagttgccgcagccgcaggctgagacagggtctggaacagaatctgacagtgatgaatcagtaccagagcctgaagaacaggattccacccagacgtccacacaagaagcccagctggtggcagcagctgaaattgatgaagagccagtcagtaaagcaaaacagatttggagtgaaaagaaggcacagaaggctatgtccaaactgggtcttcgacaggttacaggagtcactagagtcgctatccggaaatctaagaatatcctttttgtcatcacaaaaccaaatgtctgcaagagccctgctttggatacctacatagtttctggggaagccaagatcgaagatttatctgagcaagcacaactagcagctgctgagaaattcaatgttcaaggtgaagctgtctcaaacattcaagaaaacacacaaactccaactgtacaaaaggagagtgaagaagaagaggtcgatgaaacaggtgtagaagttaaggacatagaattggtcatgtcacaagcaaatgtgtggagagcaaaggcagtccatgccctgaagaacaacagtaatgatattgtaagtgccattatggaattaacaatgtaaccatctgaaagcaacttttcttggtgtctcaaaggagtaactgcagcttggtttgaaatttgtactgtttctatcataaataaagttatggcttcttgttggaaaaaaaaaacctagatgatgggttgataggtgtaggaaaccaccatagcacgtgtacacctatgtaacaaacctgcatattttgcacttgtaacccggaacttaaagtaaaataaaattaaagaaaagaaagaaagaaagttatcagaagtgttttgatggtgacacaaaagggtatacaggatgctatgggaggatggagaagtgatagaagagtcaacaactttggatgaattacccattctaggactcactttcttctgctttgtataggaggcaattatcactacttctcagttctaatgcataggttccattgaatgtttaggtgaagtagtgcatgaatcatggtta

SEQ ID NO: 14286 - DNA, 1284 bp, Homo sapiens
gccatttaagttgattacttatactcaattatcttactctaacaaattaggatccttcttaaataaagcaatgatggccttttttaaaacatagaggtgtgaaagtttatagcattttaaatttatttcaagagtagaagttactaaaatgatttatgaaaataatcttatttggcaatattaccctggcttctgacatctaagaaaaggtggcaaatacaatatgctttactaaaaactagtaggtactcatttgcaaagacactaatgagtattggtgaatatgtgtaacccatttatatcttgattacttgcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcggagcttgcagtgagccgagatcacgccactgcactccagcctggg

SEQ ID NO: 14287 - DNA, 1212 bp, Homo sapiens
ttacccaaccttcagcaactgctagtctactttctatcacttagagatttgcctcttctgaatattttagtcatacagtatgtgatctttggtgactcacttctttggcttagggtgatgttttcaagatttgtttatttatactgaggcatttattagtacttcatgcctttttaatgccaagtaatattgcattgcattctgttattaatttttgatttaaccttttttccgatttcctaagataactttggtatttaattctgtcttacaggatgttgttcacttatcaaatagtgttacctaaagatataatgagtgtgctattttatcagattattgatgaaagtataaaattaacatcatcagctataccctgcagatcttcataacatgatttgattaccccatctgtcaccattaggcaagaccctaatatatttcataaaaatcagcagcactttaaggggaaactctgctgccatgaaggaaaatatattaatattttctggcttgaaaaattagtgttttttgtttgtttgttttttaataaatttggctttctatgtgattttatgtgtaggtttgctctatgctgtaggaggttatgatggagcatcacgtcagtgtcttagcacagtagaatgctataatgctacaacaaatgagtggacctatatagcagaaatgagcaccaggcggagtggagcaggtacatgtgaacctgttttagcaactgaagcacaaaaatgatggaaaatagttaaagtaaaatgattcagtggcatcactttacattatctgaaaatatatgatatgctgattttagtggcactgctaaatgtcttttgaattgtgcaggtaatgggagtaattacaaagtaattttactttaaaatttaatgtctaagtgccatagacatttctgtttcatttatatattcaagttgttagcactccttttagttttttgtttttagtgcttattggggaacttgcttaataatcaagtcttttcatgtatatttcttaaaattttgtgctttaatatgcggttattttactatggatattgttttcaaaaggattacattaaaggactttttccctccctgtgtttcacctacatgttattaatatttttattctgtttgacatgcctcttttttcagaataatagtttgttgagatgcttatttaatcatcaattgt

SEQ ID NO: 14288 - DNA, 1104 bp, Homo sapiens
cctgtgacttcttttttctctcttcatttctttgctcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaat

SEQ ID NO: 14289 - DNA, 1561 bp, Homo sapiens
attaataaaaacaacaatcatttgagatgtatttattccttaataatctttatcatttttgtttcagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaaaggattggtttcttttcttttttttttttttaagtgcttcctttgccgaaatgtttcctggctgtttgaacatgaattttt

SEQ ID NO: 14290 - DNA, 1174 bp, Homo sapiens
attggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaacaatcctgtgacctcaacctcctgggtagctggaaccacaggcacatgccaccatgcctggctaattttttatttttgtaaagacagagtctccctatgttgcttaggctggtttcaaactccagagctcaggcgatctgcccgccttggcctcccaaagtgctggaattacagatgtgagccactgcacacagccacattattttattacccttgaatctcaacatttctcttgatattaggatttgaatccaaagaca

SEQ ID NO: 14291 - DNA, 1867 bp, Homo sapiens
agtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagc

SEQ ID NO: 14292 - DNA, 1161 bp, Homo sapiens
gatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaaccttttttttaaaaaaaaacaatgtatattatgttcctgtgtgttgaatttaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgattgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcgatttatcactccttttcatgttaataatttgaggactggataaaaggtttcaagattaaaatttgatgttcaaacctttgtatgtcccttgtgtcagtccttaaaattttgctttttaaaaaaacaaaacaaaacaaaaaacacgggacacatttgacctaatttgtacctcacaaaaattctttgcatacatctcaagcggaagatgtctacaggaatcaatttggtgattatgacacattttacctctgcaactaacaaaccttgtttatttctccaagaagcttaaaaagagtttgtggagtcgcacgaggtcatgtatggcacttgtgttcccctcttcctcttccagttactaaaataatctggtgagtgctagttgtcttagccatagaaggaaaagcagacctatcaaccaatagtatgataacccgtaagtctcagcatggcttggggacaaaatcttta

SEQ ID NO: 14293 - DNA, 1204 bp, Homo sapiens
ccaacatgttcaactttgttaatatatttataaataattatttttatggtttagattttaaggcttgatgacaatgtgtctcagagcccttgccactgataagaacagggactcttcagctgggcccttccaatgtagaattcactaaatctctaaggcttgaaaggtacttgtgatagacagaatagtgactccccaaggatgtccacctcctgatccctggaacttttaaagatgtttcattacatggccaaaaggaccttgcaggttttattaaattaatagccttttgacaaggtggttagcctgaattatccaggtgggcccagtgtaaactcaaggatgttcttaaaagggaggcaggaagcttagggccagagaaggagacgtgatggtgaagcagaggtaggaatgatagggaaatgagaccacaggtcaaggaatacaggaagcctctagaatctggaaaagacaagggaacagattcttccccagtggcctccagaaggaaccagccctgccacaccttgattttaggacccgatttttaccacaaagtttgagttaacctgttacggcaccatctagtacaggtccttactggtcatcctgtggagcacccatccctgacaaatgaccatggcttctgcctaggtgcgtgccccattgaccaagcagtgccctagcccaagactgccctgtgccatcttcagacagctgtaactcaactcaaccttccaaccgttgttctttattttgagggcccacatagaaaatgcagatctcctttctacatggtgccctgaggtatttgcaggtgtgtccccttgtgtcttttctctaatgctatacccttgaagttttcttttcctattcctcatatcacagatttcaaattttcccttattaaatctcctacctcatttagtgttccaagtccactaaagagacttctggttgatataaatttagtaattccatgattgttgtcacttaatcatgaatcttcatgactagagtgtctttagtatacatttctccatcacatctacaaggatgtcctgggagaactcaccagatgccacattgagattcacctgccttttacatcatcctcccatccacagagttctccccattgctccatcatttctgctgtgacttattgttagcgagtgtctcctggaagagttttatttccctt

SEQ ID NO: 14294 - DNA, 1128 bp, Homo sapiens
atgtgtgggaactgagaaaactatgtttgggattacatttttattataaaacctagcattttgggtgggttattgttttcttagggaggcaggtaccagccaaccacattgcttctattcacactggaggggaagaaacacttccatttgtgcaggaacccatccccctacttctgtagcttctagtaacaccactgcattctgcagttggacctgctatgcaacctgagtgaaattgatcgagtaacttaacacaggcaatgaaatgacctgaataactcaatttctttctagtaaattaatcttgggttgtatcatggataagacacctttgaaaacaactaatttggcttgacattgttcctttaaagattttataagtaattgcccgctctaagcatgtctaggcagctgcattttaattatgcatccccaccgaaaggtagaagtcatgaaaaatgatcctgaaaatagcaaaatacctgaagaatttcacatagatttaacgtattgatagacaggtgagtgttcagccactacccaccttaacaggatcttcagggaaattgttaggaggctagttgagcaccaggctgtccattggaaggccagtttgattcatggtggcgtaccaaatgaggcaatgtgttaccgtgaaagccaatggcagttgaattctgtaggtaagacactgttgtgaccagtatttatcacatcactccccagcatctagtaaaatgcctggttcaaattaggtcactggtaaatttgggttgagcagactaaaagggattctaccttccccaaataacagaaagtacagatttttttttttaatgtgacttgcctttctaaggtttagccagtatattctgttgtattaaacatagtcttctttttaataacttttcttttctcggcaggttcatataagtaccaccgggttaattgtgaccccgcccccaagcagcccagtgacaactggcccctcgtttactttcccatcagatgttccctaccaagctgcccttggagtgagtatagtttctcccatttttatttctcttttaggtctttagtcatgttaatctggcacactccacctcctaacacctgcagcgtatgttc

SEQ ID NO: 14295 - DNA, 1191 bp, Homo sapiens
agaaagactccagatggagttgaggaggagatgcattagtgagagaggaaggcaggaaaggacctatcagaatagaggtttgagaactaataaaatggcgtgtagagtccaggcatggtgcctcatgcctgtggtgccaccattttgggaggccaagacaggcatattgcttgagctcaggagtttgagaccagcctgggcaacatggcgaaccccatctctacaaaaaaacacaaatacaaaaattaactgggtgtggtgatgcgtgcctgtagtcccagctacttgggtgactagggagagaggatcgcttgagcctgagaggtcaaggctgcagtgagccgtgattgtgtcattgcactccagcctgggcaacagagtgagaccctgtctccaaaaataaaagaaagggcatgaagaaaaagcagttaacatttattgcatggcatgaattgcaccaacactttccggtacattacagtgttatctatcttcttatcttcattttacagataagcaaacttgagtatatttatgtcacagtgtgagttaatggtgggaccagggtttgaacttatattgtttacttttctaatagtgcttactgactctcaccatgagctaatgttgatactgaaaatactgcaattacaagcaagatatggtccctgtcctcactctgttattccagtagggaaggtggactgttaactatttaattacagcccacgaggataggtgctgtaggatgaggaatgtagtaggagagttcccgggggacgataccttaaactgacttggcatcagggaaagcatcccggatgaagtggatccttatctgagaactgaaggacaagttggctgaaaggacactctttttctataacttgctgcctcatttttttttttttttcggacagggtcttgttctgtcactcaggctggagtgcagtggcatgatctcagctcactgcaacctccgcctcctgggttcaagcgattctcctgcctcatcctcctgagtagctgggatcacaggtgcgtgccaccgtgtctggctgatttttgtatttttagtagagatggggtttcaccatgttggccaggctggtctcgaacttctgacctcaagtgatcaccttcctcagcctcccaaagtgctgggattacaggcgtgagccaccacgccct

SEQ ID NO: 14296 - DNA, 2822 bp, Homo sapiens
ctggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatc

SEQ ID NO: 14297 - DNA, 1212 bp, Homo sapiens
cttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctcttt

SEQ ID NO: 14298 - DNA, 1105 bp, Homo sapiens
tagcactttctgaactgtgttctatgaaccaaggtgtattatcaggcattactttaaacaggggttttgggccagtaaggttgataagtgttgcatattgtatcaccccctcagagatttcacggcatacattggtacgttaaaagctttgaaaagtactatagaaaagaaacttcagcattttagcatatctttcacaaactgacctggtcactgatccagtttttaaagaacatccagttttctttaaagaactttagtgtcctgagagaagagaaagcgctgtggacagatggacctgtcttcaggggaggaatctggctgcctctgctcgctgaattctgccttgaggccttcctttcatgttcatgtgcagcatggtatcatccagctgtgtaaatcttaccatccttcaagatcagttcaggatctacctgttctctgaagattttcctgaccacttgagtccataccgatatatctgacctcagcaaagttcctgattatgattgatggtaatgctctttagcacgtggctgtttccccagttggttcctaaactcctcaaaagcagacacaccctactttatattattcccctgtccgctgctgagtagcccctggccttactgccctcgagggagaggttaaagtgttccagtggtttttgtttggtttacaaatactcttcgtctccctggtcttgaaccccggttgagacctgcagttcattctcaatcctcaaacttgaggtgctcatgtgatcatcttacactcatatcagcacttatgctccccatattgttttccatctgaacacctctcactgatcttgcggttatttatcaaaaaagatttctgtttacagtgtatttcacaattaaaaattctactgatagttaaaataggtttcctagaacaacccctgcttggcagtcacctccatcttgctacattgccacagagcctgatgaatctgctaagtatttatgtttaggaatttcttttatgcaggaaaccccaacgttaagtggttccttgactccagttatgagtcaaatggttttaagtataacccatattagatttctattcatacagaaat

SEQ ID NO: 14299 - DNA, 1208 bp, Homo sapiens
aatgtacattccaaagatggaaacctgtgtttgcttttcatctacgtttatagagaaaagcctcactgcctggtcatgtgccatgcatggcctatgcaccctagacccctacaggcagctaccaaaagtgctgcatagccatttgggagaggtcccttacaaatccagtctgttctagatatctagggccaggccagtgtttattaccactgtggttaggttctctatttgcttctcattcacatgaattactgtgattctgaaattgcaattaatggtaactttttttttctctgtggtattttacggaaatgtatagtcctttgctcttagagaaagaacccattccagtgttgacttcaagaccataagttatttcaaaactatgtaaagattgacaatccagtaataacctgtcactacacatacccagattttccctgtaaactgtaatatttaacatgaaatgttaaattctgatgccagagttcatcaaaaactaaactgttgcctgctttttgcgtctttattcatttttttagatcagaggcttcgaaactgcttactgcattgatagcatgggaaaaacaaatggaggctttgttgaactaggaccctgccacaggatgggagggaatcaggtaaaccaccttacttttgtgtttaagttgttccgtattgagggccatcaggtttattgatcacagagtgatctttgtactttggttttcgatttggtaattttgtttgttttgataaagtaaaacattctgtaaaaaaattgacagtgttaaaacattcacttaaatgatgggaataatagcagtattggttttcacataagcagtcagaatctagaattaatgtctaatataagggattaaaatatattcctgtgggagtatatatttgtcactaccgtaactatgtaagcctagctccctaacaattttttgcaagtattgctcactaatcctcatctttttgcaaatagagtgttactgccagtaatgtatatttcactaatatatattctcttacttatgtgggtatgtttttgctttttcattttttcacattgttggtacttaataaatttgtgttagtgacccatttggtatcttagagactaaagaacttaatgatttcagtgttaataaggatcttcactaacatcaaaataaatataatttgtctgtggacttaca

SEQ ID NO: 14300 - DNA, 1316 bp, Homo sapiens
gaatcatattttgtaaaccaactaataatttgaactgtttctttttctttccagatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaatgtttgcttgcttatatgtggtgtgattatgcaaactttactatttttgtaatcttgatgatccccgttcagagtccattgagaaagacatattgtgaagaacagtaaacactctttactcattggttcagtgaatgtctatccagggctttacatgtgttaacattgtgcgaggtactagacatgggccctgctctcacagataatacataactgggtactgagaagaaaaaatctgctgaatggagagcaactatatgaagtatatcttaattaacaattatttaatagttaaaatatgcagcattagaatgatagag

SEQ ID NO: 14301 - DNA, 1193 bp, Homo sapiens
tgttggaattgttaatggaattaactgcagagagaatacaaagatatttttggttggtaactaatcaagagtattatctatttttgataactgatttatcaaaatattaaataatatatatagatggatggtttggagacattttcagtgttgtgaaaatatcactggtgtttttcggcaagttattgatgagatactaaaaatgatgtttttgtctagtacaaatggtgtgatttttctaaagagcagttcaaaggaaatatgaaatgaaattgcatataagatgattatgcagcctactactatagaaaattataatattatttagaaatgcaaaaagtacttaacttacacttcaagaatatgactcataatcgactcctctttgtcttccctctggtcatacttaagtttattcatagtaactgtacttatagataagaaaaatattcaaatttattttaggctaaaaagcataatttcaacaactaaaatgctatgctttattatgaattattgatttacttaatatattatttattatatttcaggtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggac

SEQ ID NO: 14302 - DNA, 1138 bp, Homo sapiens
gaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgtttt

SEQ ID NO: 14303 - DNA, 1178 bp, Homo sapiens
aacaaatgtgttactaccagtgtggaaactcatatagtaaaatgagttaacttaacaattaacataatacttaaaaatccaaatattaactccgcttatttcttggtattggcaccagtcttgttaattctggtgaagttcttgtcctctttgggagactgaattgagccacattggtgtcatttgcatctttgagagacattttaatgtctacttgcatgtgaccaaaagtgacatgtacaatttattatacttggttaattattgagccttgtttatgtttgcatattgttaaatttaaatggtggtgattgtttatactttagagctccagtggaattgtatttgcttgaaatatcgagtcctcttttttttttttttaacttagttgatgttacagaaaaccaaattttggatttgttcttttcttactagtcaaagtatctcagctagtaatccttggaggagtatgggaggatgccagtaatctcatactgacatttttttgttttggaataagctggatttcacaatgtatttatcttctgcatatttttattaaattagtggcacattatgtttctgggccgcctcttttctactttagtattactgttatggataaataacctaagaataattaagatctatttaaaagtgatatactgctcataaatttatattttccttaatttacttacatctagagaatatatttgattggaatgttaagcagttgtttctttatttatcagcagaatattcaacaaaaaataatgtaagtatatctaattagaagtattttaatagctatttaaagtcttactctttacgaaagaatacacatttttatatatttaaaatatctgacctgagttacctagcaaaacatcacaagccagtggaggtagctgtgttatgaaaacatttgatcttttgggagcctttttgttgttgttgttgtttgtttgtttgttttctgtttgttctatttagctctctagcattggggtctccagaatggagacttgctatatgaacagacgttaatgttcatattcagcccttaagtcagatagatgggcacatgccttctacaatatgcagatattctggaggaaaggaggaattctgtaggtcaagaagttcaccatgctacctagtatttattcatttgc

SEQ ID NO: 14304 - DNA, 3475 bp, Homo sapiens
gtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctgccaacaacttatatcgaggtaatattttattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcatgatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaat

SEQ ID NO: 14305 - DNA, 1193 bp, Homo sapiens
aatatacctttagataaagggaagctcagaattatggccattttctgcgtgattcaaacaaatttgtaagagagatgcttcttttaggatataagcttttttaaaggcgacgactaattactggtctattttacaatgtcaaattaatgataacagcagtgaagactatatggcactaatcacatgtgcctagggttagcctgtacatcatgataacttttgtataaacttgtaaatttacctttttttcctgcagtgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatgaacaagtctatttttaaaattctgttcaaccaacattaagttcctgttagaggctggggctatgccaaaccttgtatgacttcaaatttgtgttctcatgtaaagtgatgtggatgcagactataaaagtaacatttaagaaaagaagaacttgcgtgtaggcgtttaaaagagaggttgatttatatttttctaacgccctctccccgctgcttgtatttaaattttagcacagatcactatgattgttcctcctcgataaaaagtcactcttaaggtgtttctgt

SEQ ID NO: 14306 - DNA, 1134 bp, Homo sapiens
tgggtctgcagtaatttaacagcattaatgcagttatagccagcagttgattcaaagttgctgtacaaatgttccttatcgcccccttaaatcttatacttcttggtccctgaagatttactgattgcctcagaattaattggaaagtctacttttcttcatgtgagcaccatatatatgacttatgaaaaaagcacagagtttatcattttaaaaattcatctctaaattattagtcttgataacgctccaaaaaacagattgccacaaattaaaacccaggataaacacaagccctttagagaatatgcgttacactgaattaaaagggacattgtcttgggagtatttcaggtctgatttttgtgaataacgatggattgcatagcatagtgttattttatccttaggttgaattatctataaatcatgataatgttggcctgaaaagacagatgttcattctcattcttctgcttttccaacagccttgcatctgtcatcagaggccaagtactgactgctgatggaactccacttattggagtaaatgtctcgtttttccattacccagaatatggatatactattacccgccaggacggaatgtgagttagtcccatcacactatctctgaaggatttgaaatataaaaactagaccttcctgtaccactgtcatgtttgactgtccttttaaatatggaaatgcagcaactttttagactctacaaacttgtgacagtacatatggcagagatttaaagtcatatactcacatacttcttcaaaagttgattttattttctaaggcatggtaatactgtagttttgtaggagaatgctctttgtctcagcagatgtatgttgaaatctttaggggtaatattttataatgtctgtaacttgagctcagatggttccgagaaaagagtcaatggaaagcaaatttggaaaaaaaaattggtgaacttggtgaatacacataggacacaagagtatttattgtataactcttggaatattcccatagatctgaaaatatttcatataaaagttgggagaaaaagttgattttctttataaagcatattaacttaaggaggtgtgtattggtagttatgtgggatccaga

SEQ ID NO: 14307 - DNA, 1129 bp, Homo sapiens
tcactacgtagaggcctatttgctatttgcctgtaactagcaaatctttctgtgagctgaattttaaaataaagtgttatttcctgtatctatcttcattcattactttttggtttattttactgaggctattgaaaaaactattatcagacagtttatctcagattaatgccaatttccctgaatggtctaatttactcttctggcgaattaactgtagtgcagtaacttactaaccaggccatttctttttttattaaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgt

SEQ ID NO: 14308 - DNA, 1214 bp, Homo sapiens
taagaatgatttgcaagagagtttatcagcagatcacttaaaatcatgggaaaattctatttttgatagaattttaaatatttgatttagtagaatcaaatagtttatttctatttttgatgttttgtttaattgcttaataatttttgctttaaattattaaccaaaacgtgtatttccagggacatcaataaaaaaatgcataggcaagtttctaaagtgactgctgtacatttcaagcattaacctgaacactatgaaggcaatacttttattaatacttgatctattccaattaccttctgcagtctagtttttaaaaatcattagttctgcccaggtttcaaaggagaaaaggaactggggaaagagtatgttgttcagattactcaaaaaattgcacaaaaaataaaaacagattagtcagattttctcagttcatcggctgtgtccctggagtgtgttgatagttgcaaggttgaattaactctttcagggtgttccatttggcaagtcaatattccggatgtgctaacttgttccataacggttcaagagtaaatgcagcttccacaagtgtccagtttcctctttaaactcgttctgcaactgtctagattagatgatttgatggcctcatatctgtgtgcatcatcagcttcccttacacggtgattgtcagatatttaccctaacactaagctgtgtacaccagccatttaaaacgattgataataaagcaataagtttacacatggacgatcagtgcaagagaacttttcatgttttacaatcacagaactgaagattgacaaatgagtgttttctggagactttgcagcatctgtggctcattcctctgacaataaaataaaagcaatgccagcagctctcactcctggatcccgtaactcctcagcctcccaggaaggtgttcagcacagagaaagtccctggcctatgtttcaggatcctagagtggtgtcagaatatcttgaggctgcaaatgcagaaccagtgtggacactgcacttctctttggagctctctctgggttggggaaggcagtctatgaaggagatagataggatggttggggatactatcatctacatgcttcaagtcaccctaactcctcacttagctacaccgccctcccctaccccatcatcaccactaccacttctcgtaaacacacgtactgatgatatact

SEQ ID NO: 14309 - DNA, 1164 bp, Homo sapiens
tatacactttatccatttttggctaattttatgtctttatacaataatattgtgactgctttgcccctcccccaagtacactagaaattaaacatgatttgagtggttcttcactcagatgagggggggaaagccaccttactaaataattgctaattatggatagaactgcattccccatatgctcttttctcctcaaaatattgtctgtaaagcagctttgatcatgcctgtattatgactaatccagatccattgacaaatctgctggttggctatgaatgtctgggaaaataatggtactgtcgtgacaggcagcacattgtgaatctcgagccactaattgcagaacccctcacaattaagcatccaagcaaattaggcagagaaacgttaacaacacgcaaggtcaaggataactcaattaaaatgaaaatcattttctctagtggaatgtttctgtgcatctgtggtcactaaatctgcttttgcatctcccgttcacaaacactgagtaacagtatgttctctctttacagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatga

SEQ ID NO: 14310 - DNA, 1120 bp, Homo sapiens
cgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaa

SEQ ID NO: 14311 - DNA, 1401 bp, Homo sapiens
ccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagcatgtacatttttatgttattataat

SEQ ID NO: 14312 - DNA, 1216 bp, Homo sapiens
agaagttttaattttaaaaactaaaaatggacttttttttggttaagatgtcagttttaaaaacacagatataacttaggataactccaaaagatattctgagttatgggtgggaacttaaaatgagcacgtagtatattggagatggatattcatttaacccattgagggaagttttttatgtgtaaatcatggaagtctcttagtactacgttcattttctttccacgattttcatttcttctgtggtcagcctttaacccctgagttctttactctgatatacatccatagtgataattatatgattcttaaacagttcattcacagaacttaaatttatttgttattgggttttttaaaaacccacaacggaaatggaaatcatttaaacagctggtttcatcaagacatcagaagggatatcctagccgtagagatgaaaaattacctttacaagtatagaaaggatgttttgctactttatgattaagttaataatttaggaaagctggtatcctttttggccttgtagaggaaaatgaggaatcagttagttggaaaaccagttatttaaacattctcaatgtcagctgcctgaaagggaatgtatataaattttattgaaaaacacctttattcatgttagttaaatcatagcatatagaatgaaatactgtgaattgttaacaaagaaagatgtattagtgcccaaatacaaagatctctactgtgattatgttagggttaaaatgcatgtacacagattgatgctgacgtttatgaactagaaccattttgaacaaggcatctttattagtggctgcttctggggagtaagactgtagactaggggaataacttggagattatggaattactttttgggtcacttgaaatgattatgtgtatactgcactgttttacacatttaatttaaatgaaaattccctttatagagaagaaaatgttcaaatattcaaatttgtacagagaaaaatgcaagcatttgttaaaatcatgatattccctaaatttctgttaatatttaatattatttaattttaccttatctttagttttggggaagttctctttaattttggtataagttggatgtgaacaataaaatacatttatttaattaatggctggtcttgctttgtggcccaggctggagtgcagtggtgccatcatggctgactgacctcctggg

SEQ ID NO: 14313 - DNA, 1146 bp, Homo sapiens
gaatagttagcttgaaggagagaatgtttttgggggaggggtatctcttatgactggatgatgatataatttattgttcaaaccagggctctttgagactgaaggtcatcactatctatacttatcctgggatgatgggcgtggactaggactgtcttagcaaatggaaacatggttacctacttatctccaaatattttaaggtctgtcttgtgaaagaaagatcagacctcatttatgggagatttaggaccagtggacacaactacaagaagacctgcatctttttccttataacaagccataatccaattcttcagttgttgaagaatgtaagggctgccttatgaagtggtatgtttcttatcactgttgatgccaagaatctgtacagttgttctttctaagtcttgataatgtacaggttagatgaatcgatttgtaccaacccatcaaatgtttgggtattttattcttttcaggtactatgcagatgtccatgtacttattacatttagtttaatcatttggatatttctggccttttactagggaaagttagaatccatgtctttgatggcttttgtgatagctctatgtctgcagtcatgtgatcacttacaccagctgcacaacttgtccattttatcttacagcacagctccctcttttctcttcagcagagtgcagggctgttgtgttttctgtctctggcctttttctctactttcagcacctgcccttgttttgcctggaaatgtaagcgtatgctcttatttggtataacactcttctttattcctaagtatcttttttttttttttttgagacagtcttgctctgtcgcccagggtggaatgcagtggcatgatcttggctcactgcaagctctgcctcctgggttcacgccattctcctgcctcagccttccaagtagctgggactacaggcgcccgccaccacgccctgctaattttttgtatttttagtagagacggggtttcatcgtgttagccaggatggtcttgatctcctgacctcatgatctacctgcctcggcctcccagtgctgggattacaggcgtgagccagcgctcccagccattcctaagtatctttaaaattaaaaaaaaaattatgtgtggc

SEQ ID NO: 14314 - DNA, 1527 bp, Homo sapiens
tcaaaagaacagtatcattcaaaggatgcttttatttggaaagtaggttttcaagttacttgaaggatagttggtttgttggaaaaagtgaacagaaagctatagcagaaataatgctgagaggattagtattccagatgcttattaacttaaaaagacacgaacattagattaacagttattgtgccgttggccagagaatgatttccactgtagaaaatagcgggtcatgcttgatccattatctgtcttaaaacagattcaggaggcagacacctagagtcacaatgggggaccagctaaccagttcagcctcactgaggctcgaagtgtataaactaaaacattccatagccttgcacaaacatgctcttcagacacctgacaacagtttcaggggcttccttggacaaactttccagctctcaagttctggagtcagtcattaggatgcctgtggggtacgtggacggtgggtggggtaaagaggaaagcactttcgaggagagcaggcttgggaacatgtattgcaaagggttggcacagggagaggtaaaagtcctgaaggtgaaacctggggagcctgggatgctgagatgcacttttgtgacatgattttgcatttctgttgattttcatactatttattgagagcacggtagaaataacagggaagagaaataaatagtcatcatgttgtgatttatttatttatatttttttaaagtgacagggtctcgctctgccagccagactggagtgcagtagcatggtcatagcttactataaccttgaactcctcaagtgatccttttgcctcagcctcctgagtagctgggactacactagctaattaatttttttttttttttttaatagagagtctcgctatatttcctagactggtcttgaactctgagcttcaagtgatcctcctgcctcagtctcctattatgacatttagaaaaagtaatttcttcaaatcaatttggttttccactttgtaaaatgaagagagaatgtaactgatgagagcttacagtgacatccattatttcagatgcaaccataaggaagcttttctaatcaaaggccttcatttcttctttgtactgtttacagggttcttaacacaaactgccttagattataaacatttctgcatgtgccttatctttccaattagactcagtctttccaattagcctcattgagagcagggtcaagggttaaaaataaaagtgaaaacatttatgttgtgctttaactctttatagaatacttttcatatatattatttggtgtcttttaacaatatattgactgggatttccaaatgaaaactggaagaacaaggtataatatttatgttttaaaatttgatttaagattcactagagtttagttatactaaaagtgtatattggtaatatcttcatatttttatattatgtattttggagtactgaaaaatatactttacataatctctgagcaaatgtaactaaagttttatgagatttcttt

SEQ ID NO: 14315 - DNA, 1180 bp, Homo sapiens
tacaaaatgttttctatttctgtcattactgttgcggacataaaactgagttcatggactggtgttggtctgcagagtagaccaactttgattagtgctgatgcagagggcagtgtgtctacagtcctgtattaggtgaatgaaggtgggttgggtccagcttatgcagggcattgagtgctggaatgaatagcttggcttttattctgtaggcactggggagccacagaattcttgaatgatctgattgacaacattgtgtgtggtagatttatagtgagaatacactgttgatcagaacctggaagaggaaggaagttgatgagactgggtaaaataaaactaaaatttctggagaagtcactccagcacagctaaataaactccttagaggatacaagaacttaagctagcctactccctaaagcttaaacaagccggaaaacaaagttaaattctaaaaagtaccctccacctaatgttttcagaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagctgtaagtacagtgtggctattcagactttggaagtggagactgaattgtagataacagaagaccacttacatttctatggagtttaattttgagtccttttccctcctaagcaggaagagtctctcaaaaccattgagaggtgagggcacaccccagattttctcacccctacttcagataaaagaatccctgtttgggggttatgcatgccttctgtttctgcacctgcctctgccaggttgccttttatgcatttacgagttaatttttaccttttcagaacagtgcaagtagtttggccctttttgctacttttgtacaatatttttagtggggaggaactggaactattacctagagtgtaatttctgttgaccatctgagttgatttactgctccctcatctcacagattgactatttggagctggctttgtttaaagaagcagctgtgatgagctcagaagttctgcttaaattataaattcc

SEQ ID NO: 14316 - DNA, 1192 bp, Homo sapiens
ttcctaatccctaacattgatgtgagctaaataatctcttgggtcctgtccagatgtacaatggcttaattgaagaagtcttcaaagtaggaagttcttttactgtatctaaaatgagagattatgttatagatattctgtttccacaatttcagctgcatgaagtgagtgggttcctattgaaatagagataacttcttaatgaaatttttagaaataagacatgcatgtattttaaagataccgttcataggaaaatgctgttttgagatagataagacaactggtttaatatgatctcgcttccaaagtcacatgtatggaggtgcaaaattatatcctgctgttattttttcaattatataaaatggtaagtacctactaaaataaagttgtttttttccattgagattagctctttccttttaatttcacctggtagggaaggtttgctgtcttacttgttaagctttatgaaacactttgtgttttctgaacagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatgtaagttatctgtgctgaagagttggcccagtgttgtccttgatgggccttaattgcaatatggatggtgaactggaaccagaagtatatgtgacttggattctggctgtgtgcattcagtgttccattttcgtaagattagttttaaaaatcatagccttatcttttctatctaggtgccaagtatgtcaggatttgtccatatgagtagctttgttcaaactttctcatgctatattcctttagagacacgctgaaaggctagaggcatatgagaatttaactttttcctattacgtttagagtcttggaaatgtaggtcctttcaaataaacattaggccaatgagaaacagaaaaacatgccttttaagactaataagaaaacttgtttttgtaaatcttaattgattatattaaaatgtttaatttgtgatttatatctgccatttaaatatttaatgtggcttggctattgttaactattttaccttctccattttgggatgccattagcaggtatttacttctcaatacattcccatt

SEQ ID NO: 14317 - DNA, 1182 bp, Homo sapiens
tataccacttataatgccacttcagcccatgccagggcttttgttaaaaatgagccttctgctagttcagaagaaaaacttccttaacgtaggattctccctgctcgactgtgagtacactcaataaaatgaggatttaaaatccttatttctgtattcactgtcatatgattaattttacaataaatgaacaacgaataccaagttattttatagtgagtgtcaatatttttaaatgctaacattaaactctataatgtgattttcagaatatgtctattttgatatctagaagttaggttaaatttcatgagtttaactttttagtaccacattatggtgattttgctgcaggttactagagggtgaagagaggatttttttaaatgagacatttagttaaaaaccccagccaaagaaatggcttggctcattgtgtgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggtgactattccgctgtgctgtcttaaaactgataccttacaggcaccatgtggactagggagatgcttgtttgtctccttaggtgtaaattccatgtcaggattttgtgccaaaagctgatcgtgaaaggcatatgtgggaataggctctaagaagcatcataaatgctttaacgttttaaaatgggcccaagatattctccacttatatttggagaatatataagaagagaaatagtgctagttactttaaatctataaatattctgtgaatattaaaagtattttctgaattcctaggagaacaacagggtgtcttgtgtcaagttccgtatatgtagtaagttttatttccatttcaaacatgaagtaaacatttaaagttcattttggttaggcgatgccctgattagaaaagtgacaggtgacttagtttaggcacaag

SEQ ID NO: 14318 - DNA, 1099 bp, Homo sapiens
acccggcatgtgcaggttttttgattggtaaattctacgttaaataaacagctttttaaatgactaagttagataaaaagggtcaaaaagataaataagatgttgaaagtgtatttgcccaaaacattctttaactgtagatattttttggaaacagtgctatgagtaattttccgtttcatttttgagagttcttaggttttcagatgtagtaaaattgtcacatattgcctgtgtaattagatttctaaaatgtgattaaaatgaacttaccccaaaatcaacatatgcacagcatgagttggtcatgtgggtgttggctcctgatgggtgataaaaaggacaccagcccactggctgccttgcttgccctcctgactttagtccacaatctttgaagcttcataggatgtctccagggatttctaatcagtgttttgtgtgtttcttacatttttattcccttttccaggctgaacagtccaaagaagagcagaagcaaggtctgaatgcagagaagttgatgaggcaagtctccaaggacgtgtgtcggctccgggagcagagccagaaggtgcctcggcaggtgcagtccttcaggtgaatagccccatccaggacagcttttgggttgccctcacggggtctgattgtgtaggaattcacctcagtgcagtgaaagttaatatgaggatccgagacagaagtcctctgttctctaccttgaatatataattttccatttgcacctgaggtgataaatgtgactggcagagttaaaggctgatgaaagcctaactccccacaagaacccagggtgtccccagctcttagtagctgttagcacatctcactgggctatcttgacacaggatacaaaggtacagaaaactcagacatctttgggattttgttcgctcattttacagacattccttgggcagccccagaaaccttacaccttgtcaggctctgagatgtggaggctaagaacatgtgcattcgttctgctcttctggggggctctaggctgtggcagggataggcgggtaaccaggtcattgcagtgcatgtggaaggagctaactaaagggatagg

SEQ ID NO: 14319 - DNA, 1191 bp, Homo sapiens
tcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaat

SEQ ID NO: 14320 - DNA, 1224 bp, Homo sapiens
ttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtt

SEQ ID NO: 14321 - DNA, 1817 bp, Homo sapiens
ttggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaagaagttgtgttttttttctccaagtcagaaccaattcctgcaaataggcttcccatgacttgtcattataaattagacaaccaggtaattgtgtgatatacatctttatttaatttttttttttacagcaatcccctgagccagaatagattaaaagcgattcccttcaattttcaaatctagaactggatggtttttgtgtttatgcatcttttagaataccggaaagaacagagagccgtgttcagctcttgataatgagcctattcaatttaactacattcgttaaaatgaagtggaattttgttttcgtcttaggtgattctgcctgtttgtctgtcattgtatattctgtttactttgcttcaaactggccccaagatgttatttttgtggtttctggctttctagattctatttttagatactgcccattgagcaataatggtgataatatagagagaaaagaaagacctttcatgggccagttgtgttggaataggaaaatcaaacgtaagcacaatttaagtatgtagcagttattcctattttgtattctaggaataaaaagatactttaattttttatgctagaattacataattacataatcagatgttttaattttaccatataacctttaaaaatgattcatttttgaggatatttaattggataccaaagctaaaatccatatactgtaagtgggttgcctttatagattgcgggacacaataacatgaatgtattgtgaaagcacttttagt

SEQ ID NO: 14322 - DNA, 1237 bp, Homo sapiens
tcaacctcctgggctcaagtgatcctcccacttcagcctcctgagtagctaagacaacaggcatatgccaccatgcctcgctaatttttttattttgtagagatcgggctcttgccaatgttgcccagagtggtctcgaaatcctgggctcaagcagtcctcccacctcagcctcctaaagtgctgggattacaggcatgagccgccacgcagagcccaagagttgtctattcttgtctctgctttctttccttccattctttccagaatggcttcgtctcaaacactccaatacaactgccttaacattagtaaattcaattgtcaattctctgtcattatcttttcctgctctcatttgacacaaatgatcacttttaaaatgctttttctacttcgtctccagggtacaaagtacacctgctctagaatctcctccaacctcagggactgtttcttttctatctgctttgcggaatctgccccttcttgctgtcctccaaatactggagtgtcctaggtgaaggcttcagaagtcctcctcatataaccattccctaggggctgtcatcctgtgcactggctttaaacaccttttatactgtgatgactcccagtttctgtcaccaatccaggactccgatctagacggacatactcagttgcccccagcatttctgttggtatgtcaagtgaacatctcaaacttcacggggtagttcctagttttcaacctccctcccagcacgagccttctcttcttcctttcatggtaaatgaaaatgaaaattccatcttttacttgttcaggccaaaaatcttggaatcatcgttgactcctttctttctccccatccaccgcccccctcaccgtctctctctttttctttttctttctttctttctttttttttctttttttttttttgagacagggtctcactctgttgcccaggctggagtgcagtggcatgatcacaggtcaccgcagcctcaatttcctgggctcaagtgaacctcccacctcagcctccccagtagctgggaccacaggtgtgcaccactatgcccaattaatttttgtattttttgtagagatgagtttttgccgtgttggccaggctggtcttgaagtcctgggctcaagtgatctgcctgtttcagcctcccaaagtgcggggattacaggtgtgagccaccacacccgtctctttttttcccttatactccaaaacca

SEQ ID NO: 14323 - DNA, 1224 bp, Homo sapiens
tctgttgagtttagatttttgtcaaggttacattttgaaacccgtttgaagtagctgagcttgaagttgaaaagtagctacatgtggtaaaaactgtaggtgatttaagttacttaagcctcgttgcctatagtttaattttgatactccatggaaatagtgaactcagaaaataccacttgttgactattttctctcttttttttatagttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtctttta

SEQ ID NO: 14324 - DNA, 1197 bp, Homo sapiens
ccccctccctcaacaaatattctgaaaattatgggaaacagtcacttagttttaaacttcaggacatgagagagccttgggaatttcaagaaatagatattaataattttccttttggtctagcatcccgtaccacacagtaggtgcttcaagcaaaattgtaggcttctataatagcaaatgagacagcaccatttcaaacagtcttttctccacgaataagtaattaccagtgtgaaatgtgatttatagcaataggcttgacatttagccttggcctttccgataccttcaggataaactacacttaagctcaagaggttagagcgggcacctataaactagcgagctcttgcaaaaggacagttagagaatgctgaaactttaagtctcgaagactatgccttatgtgactgtttaagctcccaactcatgctaccaaatctgaagaaatcctaagaattcatgagcttcctagcaaccagtaagttcacaggccatgagatgacttcattgttcatcttgaatattaatttcccagtggtggtttctgggcagaaaggggaagatcttgccttttgttcaaatcaagatgaataataaaaagtgcatggcgttatcttaagaagaaaagggattggaccaaatggatgtgggatcattcttgggcattttctaaaagtagaagttacgatattaatgaactagagataaaagcaaaactccccacaaaggagcaaatctgtataatgaacgcttagtactttatgtatgaaaacatgctcatttgtctctgtgaaatgattttcaaggccccaaaccttttgttgatgaagttgtgagagctttctctgttagaattatgtgaactgtaagctcttcacacgaatgatgctgctaacttttaatttccttccctctcccctcccccagccctggggatgggcgcctctttatattccatgtataatgccagcaaagttttgggggacatccttattgatcaagcatggaaagtaattttttcattatacaggttctacagcacatgatccttaaaagctttgtttctgcatgagaaagcgaagtcctggcccatttgagtttgatgcttatcattttgataacatctttaaggagtaaagcgtgcgtttttaatactacggttttaaagcctttgaaaagaaagataaaaca

SEQ ID NO: 14325 - DNA, 1173 bp, Homo sapiens
catcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggtagggagaggtgtctctgtgcacacacatgcgcctagcggggcctggggctttatgcacgtaacttgacaagtttctgatttcgtagtctcagttctatggatgagggttaagagttgtatgagttgtattgttaacaatctgtttctgacttctttttcaggaattgaaaaaaatgtttctgcacctgtagagatcaccaatctggactggtgggttggctcctcccctcaaacttgcatcagtctgatctaactaaaaccaatatttccagtattttttctgctacgttcatattgccacccatgctaagagaaggatgttttttaagtccttcaaaaatagtaactttttgagtagaataaatagtctgggggcgggggaggaagataggggttgggagtaaactgattgatgctaagataggg

SEQ ID NO: 14326 - DNA, 3135 bp, Homo sapiens
ctgctgattattacatgtctgtggaagcttctggagccagtggtggagaggcagatgtgaataatcagtcgagatgtatattgatatgacattatgaaccaacagaggaaatccattaacgacatcatttgctcttcctctggggctcaatttataattatttatgttccaaacaaaacaaaacaaaccctttttgctcttttagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccacgaaatgtcaaatgcaagggtccaccttgagggaaatagatgccaaactaactagaagggaccccggccctttgtgtgtgaattgtttatgcaccagtcatttttcactgtgagttttcgtgacactattttgcaggagcccatggaagtgtgtgagaaggggtcgcaatggagatcactgggagtgaatgttttcagggttttgttttgaagtgtcacagatgcttgtctgatttttttaaccttccgtgatcacaaacaggaatataggcctttgaatctgaagtggacaaaggaaagcaatttccagtctggctggggcacagcattaggtgattgaaaaggtgatgtggacttgtaaaaggtgttactcaaatattgaaggaagagaatttcctccttgtgatacttaggatgaccctatcttactctaatagatacaataattagtttgtttaaaagcaaaatgttctttgtgatacaaatgaagagtagggcctgaggatgttattctttctaatggaaggacataaatctattttatgtagttttaaatagaatgcctaaattaggctgtgggagataatttttagtggttgtaggaaagagcaaatttagggagtgttgaacttcaggccttttattcctgggaagatatgtatagagaaaacttttaaaataatttttgattagaaatatacatgtgcccatgtaataaacaacagaatgtgctcattctgctagtgcggtataatccgaatttgtactcccctaaaatttatcagaataacaattatgcatacatgaactatgccagagtaatgtttacagatactttgtaaccaatttcaggaggcgtttttagctggatgtgtagttaattagaccaacttatttccaaatggtttgttaacattttgctttggtttacaatgtcatgttgaacacaaagaagacccagcagcaaagggatgaccaataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtctcattgcttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaac

SEQ ID NO: 14327 - DNA, 1611 bp, Homo sapiens
tgtcggcattttgcacacttatgtattattatgatacaacatattactttatggtaatttttatttttacatataactacctccataaatttgatgaaatggcagccgtgtgttaaagtgtatcgttcagaagagcaaagttgaacacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgctcataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacgcatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaagttcagggtgtttggaattttacatctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcagga

SEQ ID NO: 14328 - DNA, 1590 bp, Homo sapiens
acatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggttatatgtcttaagtggattttttttggtacttgagagaaaatattttaggtgaggttaattgacttctctct

SEQ ID NO: 14329 - DNA, 1073 bp, Homo sapiens
ttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggta

SEQ ID NO: 14330 - DNA, 1159 bp, Homo sapiens
ataaaattatattagggcatacaaatacaaatttctttcctagaacttaaacatttctattaatctgaggcagatggcataacagtagcaaagtctgcagtaaaaatccagaagcaactacaaaatgtattaaaacaataaacttgttttcccattatattcctttttaatgttccttaactttttttttttttttgaggcaaagtcttgctctgtcacccaggctggagtgcagtagtgcgatcacagctcagtgcagcctggacctccagggctcaagcgatcttgccacctcagcctcctgagtagctgggactacaggcatacaccaccacacctggctagtttttgtatttttagtagagatggggtttcaccatatcgcccaaggctggtcttgaactcctgggctcaagggatctacttgcctcagcctcccgaagtgctatgattacaggtgagagctatcacacccggcctgtttcttaacttctaaaatcctacctaccacttatacgggaaaatagcttgtttttcatatgcaaaagatgccgtgaacatgggctagaccaaacagaagaggctggtctttcgaacatggctgagtggtcttacatgaatgaaaactgtaatacagcagagtgtgatttttcaattgagatttatacacagaataaaaacttcccttgatgaaattcagctgtccgagtgaaaataccttacacaatcagcaattctagacattactcctccagccttcattaagtagctaagaaaagtgctgatataatgaagtttcactggcttatagtgatactattttaggtggactctgtaattctgtatctgcatttgtctttccccaaagcttctgatactctagcatgaaaatgccctcccacaatcatcttctgaagcatggtaaaaagtaaaattggagttaccgtttcctttacgtttggttcttgagcttgaacatctgaataatcttgataaagctgttttaaattagataagaaatatgctgcattcctaagggaagactttctctctttaagttcatcatattttgtttgtagttgtttcagctgtggctctaacctaaaacaaaaataagtgacaaataataaaatgtaccagcctatcgtggtgaaactga

SEQ ID NO: 14331 - DNA, 1107 bp, Homo sapiens
tagactagtaagaaagaagctcaaactagaaccaaggtcttcagattcctgtctggtatattactgtatattactacaattatttaaattaatacactgagtaatcttgctgtatcctacaagtggcctatcagatagattaaaattcagaaaatacagctaacaatgaagagcttatccccagtaatgttaaataacagcacaatactaaataaagatgcagtaaggtgattaaaaggcagcaatgcttttggttgctttagcagaaataggagaaccagcgagacagcagttagagtgaaagtgtatgtaggggtttgcgagactgtgcacagggataagaagtgagtacggcacctcctctctgattgttcagctgtagctatcttttacaatttggtgagactatttttgtgtcaggctttcagaaccctggacctacagccaaaatatgaataaccagcatgttaacttatcttaatattttagatacttctgacattgtgcacatttggtgtccagaaggaatgaaaaccagtgacatcaaggagttgaatattgttttgcctgaatttgagaaaacccacctagagcatcagtaagtcttttgatgatgtgctatatttacctaataaatttcccctgaagcaccatttttgctcatcctacagtttttgttatgtactattttcattgtcattgttttagatatttttacattttattataattttttctttaattctttgaagaattcatatgtttttatttgtcccaaatatgtagacttttaaatttatatttttgtattaaccttctatcttaaatatgttgtggtcaaagatcatggtccagtgatacctttttttttttttaaattttgaggctttcttcatgacctggtacatgatctgtgtggaatttctaatcattagatctagatagaatctctaattattggatctatgttcagtttttcttggtacttctattcatttgtgctgtatatatttagagactattaggaaaatcatgtttaaaattgctctgtcttgcaaattgaacattttagttggtcacccactctattcctaaacatactttgtc

SEQ ID NO: 14332 - DNA, 2045 bp, Homo sapiens
gtggcccgtgtcctttttcctcttttaactgccttgtttattggcaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtgagtgaggcatcttttttaatgtcatgtttaatattcggaacagcctgtaatgtgcacaagcgaagagcaagaatggccctgggcctggaatccttcccagttgtcttcttttcttcttagtcaccctcctctaactcagctggcctcaggcactgacagacactgacccgagcctcccaccaggttgtctgtggcaaaagtcctaactggttgtggaaaagaaagtcatggtgtgaataacagagaaggtcctgaaaatgcagcttccttgctggaaaatgtatttcaggcgacgctggctgtaactggtgattccgtggtgaatgta

SEQ ID NO: 14333 - DNA, 1448 bp, Homo sapiens
tccttcctctattagagcatctagtagagatcctcatctccagggtgatcagagtgacactgagaaattgtcattttttggccatcatgtctattaaatccaaagccctttgaagcagggagtgttactcatttctgtcccccagtaagcccctcatacagttctcaaacctagggaaagtgaaataaataaatggctatagctttatataattcaatcaccttttcagtttatttggggcaataccttttccctcaaataccctaataattgaagcaacattggattattttggcttgttatccagtaactaacatggataacagtatccatttacacgtcctcagtatccatttgatttcctcatcctttttttcttcaaaaaaaaaatctaggaagtgcaaacctttttttttctcctgtcctcttcccttctctctaccctgcctgtcctctgtcacccaccctcccctccaccaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagc

SEQ ID NO: 14334 - DNA, 1448 bp, Homo sapiens
tagtctctgagtacattttatattatctttgttgccacatgtcaggatacaacacaatagttttataaataacaactgtactttgattttaggtactaatttaatgctttagtttttactactttgaaaggggaggttcatctaagtattactgataacagggatccaacttaaagtaaaagttggaaagggcaagagtcttttaagcggaacttcaattctgttgtcatggttacttatatataatgaatataaatagacaaataggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttattttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataactgagttttgatcctatgtttatctctaaaatgggctgtcttgttccaattttcaaaattagaataatttttacgtgccttacaagaccaagaattagtaggaataaagttggaaggatgatgtcagttatttctgtctttgaaagtatttacatggaaaagagtttgcttaaaattatattcttaatcagaatttctttaaactacatcatctaattgcttctgtaaaattattatggtactacaatacagtggacactcttacagcttaaagaaatgggcttgttgttgttgttgttgtttgtatttttgagat

SEQ ID NO: 14335 - DNA, 1291 bp, Homo sapiens
cagtctccccagaaggcagtgggccacagaagtctagatccccctcacactcatttgcattatcctgttgcctggtatgtcatgagtttttaactgaaacctgctgatgcgcagatcaagaaatgggactagctgaaggacagaataaaagcttaagtcacagctttaaaaataactaaattactttaaaatgcatgtttgaaaaaaagcagtgaatttaaaattatttacttcctgctgttttaagggagtgaaaaataaaaaataagttaaaagccttagttttgaaattcaaaatggttagaaaactattttattgtctattaattcactgattataatacagcgacagatttttttttaaattagcttattttaagccttgaataaggctcgagaatcaagcttttctgaatctgtcctctgtgttgaaaatggtagtttctgcatgaaaactaaagaattaaggctaaaatacgagcagatagtttggaatttacacttgaagagggagaacaactctaccaattttcttggataagttatctgcttcctatgactttgctgtattcccaggaggagacagaggaggacagtgacctgtcagattatggtgatgatgtggatgggaggaaagacgccttggctgaaccatgtttcatgttgattggggagatttttgaacttcgaggaagtaagcttctttgttattatttagtggtatttgctagttaagtggtatatataatcgtacattcacatgcatttaatatccctttattgctgaaatgcatcagacatgtatttatattcatgcatccattcattcaacatagccttttaagagccaacccaggccgggcacggtggctcacgcctgtaatcccagcactttgggaggccaaggcgggtggatcatgaagtcaagagatcaagaccatcctgaccaacatggtgaaaccccgtttctactaaaaatacaaaaattagccgggcatggtggcgcatgcctgtaatcccagctacttgggaagctgaggtgggagaattgcttgaacccaggaggtggaggttgcagtgagccaagatcgcaccactgcactccagcctgggtaacagcgagactccgtctcaaaaaaaaaaaaaaaaagagccaaccagatactatgctatatatacaaccccaagacagatatcatctctgtcctaacgtaacatagcgtcctgatttactctgccccatgttcctctgactacagaaggttagaatccttcacgttgctttttatgt

SEQ ID NO: 14336 - DNA, 1369 bp, Homo sapiens
cgagtagctgggattacaggcatgcactaccatgcccagctaacttttgtatttttagtagagatggggtttcgccatgttggctgggatggtctctaactcctgacctcaggtgatctgtctgcctcagcctcccaaagtgctgggattacaggcgggagccacctcgcccatcctcccttgacttttgatatcacattgccgcataactggttggttttcttatttcagcaaagccaactgtttcccagtcatctctgattatagttaccaatattaaatactgtttgagagttacttgtttactgagataatttcagacctaaaattagacttttctcttagatgcagatatttattttgaataaacccttggagaaaaacatttttccacttttttccttctttgttggttcaggcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctctatgatatttaagatacttatatctcaaagaggttgaaactctacaggctgttcaaatatttatcaaatgcctttttagagaaaacactatgtacttaactacttctgcagggaagtaaaagtttgctgccttctccagaaacaaaataaatctgtaaaatatatgatttttagtgagcagaaagagccaaattagtgcttgaagtgaggcattagggaggagagatgggagctgacccttggagtatgggcagggccgagatgggggagcggaaagaggagggcagctacttcaggggctcggttgtattatcaagccgtttagaccacagggacattaggggagatccagagtaca

SEQ ID NO: 14337 - DNA, 1099 bp, Homo sapiens
tccagatgggaacaagcaggaatgtgtatgatttcttaaagacacctcaggtgcctttggtctctcgtattgtatatacagtgtatatgcaatacagtgtacaatgtaaagtgtacagtgtacaataccgtgtataatagaaagcagtgccaaggtctactagttttctctacagcagcagtcaacagtcaagttagagaacaggtggggaactagagacagagtgggatagagagagagaggaatgagccaggaggacacgtggaatccaggaggcaacggagccctgaggtgctcagatggaacagggtgttcagacaaccgcgagtaccatgaaccaggtgtgggacgacggtgtgtcccaggaacagggtgtgatgggtacagcatgtcccaggaacagggtgtgaggaggacagtgtgtcccatgaacagggtgtgaggacagtgtgtcccacgaacagggtgtggtgtggacagtgtgtcccacgaacagggtgtgaggaggacggtgtgtcccacgaacagggtgtggtgtggacggtgtgtcccatgaacagggtgtggcgtggacggtgtgtcccatgaacagggtgtggtgtggacggtgtgtcccatgaacagggtgtggtgtggacggtgtgtcccatgaacagggtgtggtgtggatggtgtgtcccaggaacagggtgtgaggaggacggtgtgtcccaggaacagggtgtgaggacggtgtgtcccaggaacagggtgtgaggacggtgtgtcccacgaacagggtgtggtgtggacggtgtgtcccacgaacagggtgtggtgtggacggtgtgtcccaggaacagggtgtggtgtggacggtgtgtcccaggaacagggtgtggtgtggacggtgtgtcccaggaacagggtgtggtgtggacggtgtgtcccaggaacagggtgtggtgtggacggtgtgtcccacgaacagggtgtggtgtggacggtgtgtcccacgaacagggtgtggtgtggacggtgtgtcccacgaacagggtgtggtgtggacggtgtgtcccatgaacagggtgtggtgtggatggcatgaacagggagcgag

SEQ ID NO: 14338 - DNA, 1371 bp, Homo sapiens
gtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttatgcctctttttccttcccattgatactcctgttcaggattcagtggctgagatagaagaatggatgaatggaagggtggatattgatgtatttgcttttagtggacaaggcgtaaatgtgaaaatcctctctaccctgaccaaaagccctgctgtccaagcggagccagccaccaggtggcagtatatagctacttgatacggctcaaaactatagccacaaaagtaaaaagcataactttttaatatttttaaacaaaaccaagaaaattttatacatttttaattagtatgaatttattggttgtaattttaatgcttacatgtttttcacctttgtcaatgttttatatcaaaaacagtctctgtgaagcattatacctttctgttgtcaacttacacagtactgtatgatttaatgtgagatccagaagctattttttatatatttttatacagtcaaaatccatccctacttcc

SEQ ID NO: 14339 - DNA, 1454 bp, Homo sapiens
attctgtcatagtcattgacagagctgggtttcagtgtgaattagtgaagtgctataaagaaatttgtccttttctttgatacgtttcttgtgtggagaaatgagtatctaccagttagtaattttttgggaacttgagtaatacaaatgtttttattgaagaagttataaacagtgccatagacaaaggtgattttatttttcttttcttgtaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaaggtactgcacatgagtgtatgaaagtcggtgtcacagatggtttcagacggcctttgaagcctttgatggctatacatgaaaggtgatgttcttgaaatgtctgttaattatcttttccctttctcccctctttgaatgaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggtgagagttgaatggttgggtatacttttatttttaaaaatcggtttcattgtttcttaccattttcttctttattggagtctaaaaatattgcaaagtatgtttattgtaagaagacagatgtggagatgaataaagaatgacagtagtaagttttgcttcct

SEQ ID NO: 14340 - DNA, 4118 bp, Homo sapiens
ttccaccacacattcccagtgcagccgagagagggagttttggcttcgctaagagcagagtgctgtttcttctgttttttgtttttcatcatttatggacaaaattctgtaaagtatacctggttttaggtggataaaaataaaacaagttgaaggttccattcaaatattgacatcccctgagtttctgcttaatttcagaatataatttttaaggatactttgtttctgtttctctaactactactactactgccccttgtgtttttctgtaacatgtattttttcctctccttccaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgac

SEQ ID NO: 14341 - DNA, 1108 bp, Homo sapiens
ccaaagtaggtttcaaaagcctataaagaactgttaaaagttaaagttgagacaaaatggaaccaaaaccttaatttaaattctcttcatgactttgtatgaacactgccttttgggttttttctttcaagtgaagaagagtatttttattgttgctttttaaggaatcatttcgaaactagtatttttcacctacacatttaagagattgggatatttttactaccaagaaaaaaaaaataaggaaacaaccagccaaacgaggtggtgtcccaaaatagatttatggtattttccagaaagggcagtgccagacttttccagtagtaatttagtgggaggcggggaggtgttgggattgtgggcagtgtggttggtaagtatataagaaactgtgtgtaaatattgagatttaaaggtgagagagaagctggaaatttgtaggtcatttattctgtggtccttgctttacagagaaagtaagtagtgtacagtagacttacgtttatatgcttttggaaatgaacaaaagtgatagaataatatttacacattggacctcgtattcattacaagatacattttttggcagaagaattatcagcccaagttatttcttcagagattcctggcaggacaattggtatcacagtgtagaaactcctttaggaaaaatcagtatattttgttggctaaaattaggcatgctaattattcacttggagtgtgtcttaactaatttctagggcatgaaggaagtgtggaaagatgcgtgtcaggtgaagagatggaggggcagttgaggaacacccgtgggggctgccagagactgcactacagcttggtgtgccttggcgtgcacccggcccaggccaggctggtgcttgctggaacttcgctccttgcccattgcccatgtccaccagggtcttctttgcctaactcgggggcatttaatattgcgctaattaatatgagcctgtgcaggagtgctgtggctctggggaccaacaacctgtccacgtaactgtttgcttcttgtctttgacttaaagctactagtgttggttgagtattataaccaaatttttgtcatattttacctatt

SEQ ID NO: 14342 - DNA, 3135 bp, Homo sapiens
acattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatga

SEQ ID NO: 14343 - DNA, 1202 bp, Homo sapiens
aagagcataataataagtcgtgaaaaaaaattcacatccagaagttggagggccacaaagtacaagtcgtccaggccagtctgcagagactgttcatgcttccgcccagcaaaaatctggcaggcgacacatcgcgacgaatttcggctgcagaagaggaagagcatcacctgcagtccgcggcgtgggaaacgccgccggaggggctccgcgagccggggaagtgcgcgcagcggggctccaggcggctccaggcgctgagtgcgaggaacgcccgcgctcgccggcgcccgggagacgcagccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactggtgagttctttgttcaaatcgtgcatgccttttggcatttaagtttaaacgttaatgaaattacgtggggtgtgtggctctaagcgagtgcggggaagcgtgtgcgccctacgggttctcggctccaggagctgcgcatccctctggctttgtgcggatcggcgatgaaagattcgtatgcatagctttgggagttcataaaatacatatagagcactgttaaaaagaacttgagaggcgatgctgtttgtgcattattttgaatgtaacttattatagcaatggtgcctagggagggcgcatcggggccgcgagatttgcaggggcgcagc

SEQ ID NO: 14344 - DNA, 1059 bp, Homo sapiens
tgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaa

SEQ ID NO: 14345 - DNA, 2688 bp, Homo sapiens
gtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggct

SEQ ID NO: 14346 - DNA, 1154 bp, Homo sapiens
ccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccaggagtaggagcctgatttaatatccagagcctttgcatttgtgtaactgtcaacacctgtgtgtagtggaagaggttgcacttaacctgaatcatgaatgataataacggggagatcctatgctaatgagaaaaaatgcatatgcatcgtaagcttggggaattagagaagaaatacagtctggggtccttagaactaggttaggaacttgatgtatttctgaaaacatttgcagaatcaggtataatcaggaatgaaagcgggactttagatatgagcatgccaccatgcggaacaggtgtccattactgacagtgagtatcaggacttcctaaagtgttttattccaaatagagaataataatttatatagatattttatgtggataagaaggagttgtggaaaatgtgaatatttttaaattttcttttctttttcttttttttgagacgaaatttcgctcttgtcgcccaggctggagtacagtggctcgatcttggctcatcacaacctccccg

SEQ ID NO: 14347 - DNA, 1163 bp, Homo sapiens
tcttgagaggaatcctgcttcagcagaagaatatcatggccttgcctaattatgtctgttcctggggtagcaggcagaaaagcagggtttttttttttttggttttggttttggtttttttttttgatttggagtcttgctctgtcattcaggctggagtgcagtggcacgatcttggctcactgcaacgtctgcctcccaggttcaagcgattctcctgcctcagcctcctgagtagctgggattacaggcacccgccaccacgcctggctaatttttgtacttctagtggagactgggtttcaccatgttggccaggctggtctcaaaccctgacctcatgatccgccggccttggccacccaaagtgctgggattacaggcgtgagccactgcgcccaaccgaaaagcaggtttttaaaaacatggttgaattaatctataggagaagttaccgaactcttgttcctgaacttgaggttgttgaatagtaacgaagaaatgcttctgcagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaaggtaagatgctgggaaaaagaaaataaaattcattccagtatttgagaaatgagaagtggacagtactcattaggggttgctgtcagaacacaatatccaatgatcttcaaccacaaaagaaggctacatgactttctttcagctgccaaaagctttaggaatggtcatagctttgtgggatagtgtggagctgcttcatgagatgaattctcaccttaaaattatcagcagtaagttagggttgagatgtgacacaatgtggttaatacctccatgcaatgaaatattctgtgatcataaagaataaaacagctctataggcactaacagtatttcaagcactcattaagtgaaaaagaaagatgcagactgctttttgtttgatctttggataataagtatatatacacacacatatacatgtgtggttgctaacattcacagactttctggcaaaaaattaataaatgtatagtcatctgtgataatcttgaaacaagggtgagatt

SEQ ID NO: 14348 - DNA, 1145 bp, Homo sapiens
tcagcctctagcatgtgtgcttttcacagagataagtctcaaagtttggggttggtgaggagcccagtatacaggagttccacattaagtcataattggctttgtgttggacagtgtatgtcagctggtgaaatcaggcacagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagtaagacagctgctcagcatgaaccccacgactcatcgcagctaactccgttagctttcctgacgtttcctaacgtcctctgtgggggacagtcacgagggcccatctgagcaccacatcacaaactggcgtgggtccagtttacacccttttttttccctttttttgtttttgagacagagttttgctctgttgcccaggctggagtgcagcagtgcgatctcagtcactgcaacctccgcctcccaggttcacgccattctcctgcctcagcctccccagtagctgggactacagtcacccaccaccacgcccggctaattttttgtatttttaatagagacggggtttcaccatgttggccaggctggtcttgaactcctgacctcaggtgatccgcctgcctcggcctcccaaagtgctgggattacaggcgtgaggcgccgcacccagcctgc

SEQ ID NO: 14349 - DNA, 1760 bp, Homo sapiens
agtggcgcgatcccggctcactgcaacctccacctcccgggttcaagtgattctcctgcctcagccttctgagtagctgggattacagacgtgtgccaccatgcccagctaattttgtatatttgtggagatggggttttaccatgttagccaggctgatctcgaactcccgacctcaggtaatccacctgtctcggtctcccaaagtgctgggattacaggtgtgagccaccgtgcttggccgtagactttgaattcttaagtgagagtatttgccatgtatgtttctgttcctttttggttatctgacacctactttcattgaataaatatttgttgaataaatgaacacacatttttcataatttttcttaattttgttttatttgtatcatagtcctgatcactacttgtcatatttcttactcatttttggttttctccactagaacgaccgcctcctgggaatggagattttggttttgtttactattgtatctatagcgcacatacctccgaaaacatcaacctctacacccagcgcatcaacagattaaatgtattatatgttggatttcaggaattgttgccatgaaactctaggacttggccaggcatggtggcccacacctgtaatcccagcactttgggaggctgaggagggtgggtcacccggtcaagagacttgagacaatcctgaccaacatggtgaaaccccatctttactaaaaatacaaaaattagctgggcgtggtggcacactcctagactatagtcccagctactcaggaggctgaggcaggagaatcatttgaactcaggaggcagaggttgcagtgagccgagattgcgccactgcacttcagactggcgacagagtgagactccatctcaaaaaaaaaaaaaaaaagaaagaaagaaactctaggacttgtaaggattaaaaatctacagacaagggcatttctcttactaactttatctcgtgtgtgtgtgtgtgtgtgtgtgtgtgtgtgtgtgttttggcaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggtgagaataacattcatgagagtaatgggaaaaattatagtaactcatagtacttcaagccataggaaataatgttttctttattcatcttaaaaactaagttctggtccaaaagtagttttcctaaagaattgacattctatatgtcaataaagccttatagaagagagagagagagaaaaaaaaaaacacatccagaggaataactatcccaaacaagcctgagagtggcttcaatttcttctgtacctgcctctctgcaacctcagctttgttaatttttttttctagtttattaatgtgtatttactatgtgctgggcacattaaatttaatcttcacaaagacctgatgaagataagtaccattatgatatgaactctaggtctagatgactgtcatctacaggatgggttaatagcggcactgatttaattattcatacctgtggtactaacgagatctgcccgcctgatagttaatagacaggagagccctcc

SEQ ID NO: 14350 - DNA, 1124 bp, Homo sapiens
ttgcggaggtgccccaaggccagcccccaggtgcgtgacctgctgggagatctcacaggactcagcacagggttggactcagcacagagcagaatcagcaaagggagagggtgtgtgggtggcgctcagaggagccacgtgtggacaccccaggatccactccctggagtcatacaggacacacctaactattaagaataagctcactggagactcagcacctggggcttttgctaagggctggtcatgtggtaccccctgcctggcctgtgtgggaattccccacttgtccagaaggagggtgggtttggtgtggtctgtgccgtgagcacaagtactgtggtcacagagccacgcgtaggagttaatggtgctgggaagtctcccagaatccgagttcccagatgtcagtcaagggccagccttgcacacaggccctggtaggacacagccttgggcctgctgtgtgaattcgtcaccacgcacctcactttacggagatgtggaagagctaacctgcctgaggtcacgcaggtagtagtgttggagccagtctgagcccgggcaccttttctccagaaccgcgagtaacctgtgtgcagtgatttgatagtgtgtggccaggcaggagcgggagcaggttgtccatctgctttcaagggccatgttctcccctcctgcccgtctgtacgggagtaggagcaactgttaaaaatcctaagctcatagagcccacgtggcagtatgagagccactattcatggagtgcatgttccaccctgagctgtacacgctttacacgcatgcgttgtttgaaatccgtggaaccccttgagcgcggcggaggcgggctcagagccaacatgcgctgcctgcaacagacacgggccccctgccatgctctgctctcggcacccacgccctgctaagggtgctcagatgcttcacccaggcaggagtgcagtggtgtgatggctaagggtgctcagatgcttctcttcttcagtggctgctagcgtgcctctctgctctaccaccatcgctttatctgagaaaaagtcacttttattttcattttttattttttttgagagggaatctctgtcacccaggcaggagtgcag

SEQ ID NO: 14351 - DNA, 1161 bp, Homo sapiens
cataggcgagggtctgtttctaattaaagcaggttttcctgacagggctgttccaagactccaccagtgctgtgggccctggagagtcagagggtcagctctgggaattagattcgcgttctaggccgagacccaggagccaggggagctggggccacttaccttccccgtgcctcggaagctgagtgtgaagctctgctcttctttctgtcgtggctgcggctggatttcctcacacatcccattgcacggcctgcctcacagctgcaagtgcaccttctcctgggacttagggggtcagggctgggggacaatcccccacacccccacccagggcgaaggtgacaagactttaagggatttcaccccattcacagacaggcatgcattgcccagtccctggttagtggtcagcagtggggccccgccaggctctgagggctgaggtctggtgggaagcctcaagtgagtttgctgcaactgatcttttgctgcttgaccgttcctctctgtctcagccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggtaactcactcactctggcttgtgtagcgtgtttcattttggaaccttggagccgttgaagttctttaaaccttgttggacttaactgattgtctaaccaggctacgtaaagtttttgttgacgtcatgcaggttcatatttgatattgctcatgtcggaaggcgatcctcgacatggatacgtttattcaggtttttatccaaaatgagataagggctatgcaagccgttcatcttttctgaagtggaatgatgtcgtgagcaaaactgagaatgtggcttttgaaatcatttaaaagtggatccatgaaaataccgtggggcagggcagcttatatttcatgatagatcaaagcacgttgaaaaggcaacagtcacctaagaaacagctgtcagtcaccaggtccaaaccgtgcgcctcagaaggggcgttaggcagaacgcgtgcccattctcaggtgtgctcggcgtgtgtgtgctcggc

SEQ ID NO: 14352 - DNA, 1379 bp, Homo sapiens
tgccagatggccccaccaaacgtgagttgagcccctccagcaatgaccgtgtaccttctaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaactttaagcctgatttatggtgtggggaccttatggtgtaactgcatcatccagaagaaattgggaaggtgccagtggcccaggtgcagattcaggaggtagatcaccaaggccaaggcatatgcaggttctggtcaccgtgtcgtctgctgggccttaactctagattcagaacccggagccactcctgccgtggaaagcagagc

SEQ ID NO: 14353 - DNA, 1488 bp, Homo sapiens
tctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatc

SEQ ID NO: 14354 - DNA, 1146 bp, Homo sapiens
agggcctcggcgggggcctcaggtgtgtgccccgggccattgtcccctcaggggcctcggcgggggcctcgggtgtgccccgggccattgtcccctcagggcctcggtgggggcttcaggtgtgtgtcctgggccattgtctcacctgtctagcatgtcacctgtcccacctgtctaacctacctgttctcctgtcctgcctggctagtgcccacctgtccatcggccctgcctgtcccacctggcttctgtggcctgtctcacctgtcacctgttcaacttaccccacgtgtgtcacgtttccccatcccatctgtcacctgccccttttgtcccctgtcccgcctgtcatgtatctcccgtcccacctgtgtcgtgtgccccgcccgtcccatctgccctgcctgttgatgggccgtgccctggtaagcgttgccgtggtaacagccgccccaccctggctgcaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggaggtgggccgggcggggtctgggggccaggcctctttcccaccccagctgcacaggaaacgtgccctggcatgtcctcatcgcagcgtgtcaacacggtgctgtgcgtggcgctgctgtgttttagccgtggcggtggctttgagctcagagcagcgcgctaaggcctgggagcaccagccgcaccccgggaagcttgggaggtgtgagggccattagctttccaagggcgaaccctgggaccgcctcctcccgccatgggtgagccccgtccagagccgtaatcatggttctgctgcaagctcagtctcccgctgttcaggctcactgggggctgcataagtgtgatgcccgtgtgctgggggctcactgggggctgcataagtgtgatgcccgtgtgctgggggctcactgggggctgcataagtgtgatgcccgtgtgctgggggctcactgggggctcactgggggctgcataagtgtgatgcccgtgtgctgggggctcactggggg

SEQ ID NO: 14355 - DNA, 1143 bp, Homo sapiens
gtgtctccgccagccttcgtcagacttccctcttgggtcttagttttgaatttcactgatttacctctgacgtttctatctctccattgtatgctttttcttggtttattctttcattccttttctagcttcttagtttagtcatgcctttccctctaagtgctgccttacctgcaccctgtgttttgatgtgaagtaatctcaacatcagccactttcaagtgttcttaaaatacttcaaagtgttaatacttcttttaagtattcttattctgtgatttttttctttgtgcacgctgtgttttgacgtgaaatcattttgatatcagtgacttttaagtattctttagcttattctgtgatttctttgagcagtgagttatttgaacactgtttatgttcaagatatgtagagtatcaagatacgtagagtattttaagttatcattttattattgatttctaactcagttgtgtagtggtctgtataataccaattatttgaagtttgcggagccttgctttgtgatctagtgtgtgcatggtttccagaactgtccattgtaaatttgacatcctgtcaatagtgggcatgcatgttcactatatccagcttattaaggtccagtgcaaagcttctgtctccttctagatgcatgaaattccaagaaggaggccatagtccctcacctgggggatgggtctgttcatttcttctcgtttggtagcatttatgtgaggcattgttaggtgcatgcacgtggtagaatttttatcttcctgatgagtgaatcttttggagacttctatgtctctagtaatctagtaattctttttttaaattgctcttagtactgccacactgggcttcttttgattagtattttcctgctgtgtctgttttctgcctttaatttatatatatatatatatattttttttttttgagacagagtcttggtctgtcgcccagggtgagtgcagtggtgtgatcacaggtcagtgtaacttttaccttctggcctgagccgtcctctcacctcagcctcctgaatagctggaactgcagacacgcaccgctacacctggctaatttttaaattttttctggagacagggtcttgctgtgttgcccaggctggt

SEQ ID NO: 14356 - DNA, 1129 bp, Homo sapiens
tcctcctcttagaaaaatagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaagcctttgagtcatgagtgttcttagatacgtagcatcttagttgtttaagactaaactattgtacagagccatgacccatcaggtcaagcttatcttgccctaggttgaggcagagagagagaaatggaatagaaagatgggtggagaactgctggactcggtgtgtagtgaagtttaatgtttgttgaagttagtttttgtggggtttgttgttctcagctcacagcagcctccacctcccatgttcacacaatcttcttgcctcagcctcctgagtagctgcgactacaagtgtgcaccaccacatccagcttttttgtattaatatttttagtagagatgtggttttgcca

SEQ ID NO: 14357 - DNA, 2544 bp, Homo sapiens
acatttgctcgtccccattccataaccacaggtgcctttgtctttccagctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaatgatgttgttttgtgtggttctttattagaaagacaacaacaggcattgtgagaggagagccaatccagatgagattttcttggtg

SEQ ID NO: 14358 - DNA, 1106 bp, Homo sapiens
ccccgggcttcctgtggagatgagatggggaagttcgcacgcaggtctcagcttccgccctcagctctgagcgcccccccccccatattgcgatatgcgttttaggtgttttaatgtttttcccatttcaaaatgataggatgctgataaataagttgctaacatgaaggtccggaggtcttctggcctgggacttgtgctgtctgtgttccggagtctcatgttgtcttagcactgcctgccgcgtggcccgtgaccaccacacagggccccgcggcctccttcgtaggtgagagcgcagccagcgaggacacaggcggaggccaggaaggcgcggcgtcttttcttccctcaagcagatgtcccagcggcggcgaccacaggaagcccgtggcctggactgcgccctggagggctctcccgtgggaccgcccctgtgcctcacacagactccgagactgcggacgtgtgcccgcgtgacgcagcgccctcttttgcagggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaagtgagtgagacacccctgctgggagtgagggaccctgccctgctgggagtgagagatccccctgctgctgagaataagagattcccctcctgctgggagtgagggtcccccctctgttgggaatgagtgagaccccctctgttgctggcaatgagggactccctgctggtttttagggacccccccttctgggaatgagagatccctccctgctaggaatgagggacccccacttgctggaaatgagtgagaccctccctaccgggagtgagggaccccccccccaccacgctgctgggagtgatcgagcccccaccgccgggcacattggccttgtgccccattttctgtgttggggtttcctgtgtaattttcgttgttgtaattgtta

SEQ ID NO: 14359 - DNA, 1264 bp, Homo sapiens
ctcagggactcaggcggctgctgggcttggtgttctccccaaagcagagtcctggttaagggactttaacttcgttagagctgacatttattaaaagctgtcattatcttgttgcctgtcctgaaaaggggacagtgtaacaggcataaatggttaagcagcctagagtgggactgggcacccggcatgtcccctcctgggctccagccctgaaggccaagcctggttgtgcctcactgtcgtgtgcagcacccaccgcctgctccaggccgctgaggtgtggggagtgaatggagctgcaggctgacagtgatgtccctgggggtcctaggggatggctgcgtagcccggggtgggagcctgaggccaggggcttcggtcagcctggaaccgagatcgacagtctgcattcttacttcagtagtaactgcgtatttttgtttctgacagtctaagttttatacatacattttcaatgcttaatatctagatttgaagtagaatatggaaatatgacatcattccttttgaattttttcaggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaatttgtaagtttgtttctttcatagtctgggctttggaagtgaacatccacgtggacatgggtagacatgcgagtggaagcagtgcccgctccagtgagcctgagctgcctcctgccggccgctgcctgccttaccggctgcttctgtgtgtctcctcttatccttggggccacgtgggctgcaggaatgggcggggggcagggaaggagaaggagaagtgcctcttgttttgcagatgcaactgtgcttcagagagccaaggtgggtcttgaggtgcatagtgaaggagggtgcccaggcctcaactggtcctatgggaaggtcagcctctctcctgttgctggcttgcagagctggtctatccgtccgtcctagtccctatgttgaaatgtcagatcttaaaacccaagaatttaagcactggtttgaaggcatcgaaagtcacatactggccacattaaggacagtctatgtttttaaaagagtaaggattataatgtagtgtaacataaaaataaaagt

SEQ ID NO: 14360 - DNA, 1319 bp, Homo sapiens
gacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatatatacatgtgtgattcctgtttttgctcttaggaagcagaaagaacaaacttacttttggctaaatggcagtgttagaatacatccttattttctctagtgaaagcggttttactgtgaaggctgctgtcttcctgtctacctcattttgtgtgttggtctgtacaaacaccgaccacacactgcctttggtggatttgtctctggagtctccactgtggaatactttcaagctctgtggcgtgaagagctcctatttctctttcgcccacattctccactgaacatttctctacatttgcatttgcatcctctggtgtgcttgcatgtcactcattgttttctgaaccctttgacagtaagttacagacgtgttccgttacccccttgctcctgtggtgtttcctggaaacagaggccctctttacagctcgcagcataggcgtcagaaacgtggatgcaggtcaccctcaaaccagcaagctcgctccagcggcccagtaatgt

SEQ ID NO: 14361 - DNA, 1112 bp, Homo sapiens
attcataccctcctttctcgttatttatatacttgtctttttgcccctgccgggtattttagaaatcgtgcttggtgcactttgtgtccttcagtgtgccttacccagagcagatgcacgataagcatttttacacgagaacaagctggtggtgtaggcctctgctaaggaacaggctgtatatgctctttgtgggattaaggtagaatcagctttaactccaaagaaactgtccatgaattttgtttataatagcaagtagatttaaaatgacactttaaaaaaattctgttgtctttctctacatataatgctgtagaaaaatataactgatggattttgtgaacgtggtatttttaacttttcgtagcagcacaaagaatgctcctctttgtgtgtcaatgaaattgttctttatgacagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtgggtaagaaaagtggttatgtcttgatctaatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttaccacacattacagattgatttgtctcatcctgattccctttttagtcctcctccatcaaagaaaatgaagttatttggatttaaagaagatccatttgtatttattcctgaagatgacccattatttccacctattgagtaaggattcagcctttttaattattcatttaaagaaatttactatagagtatcaaatgtacaactgatcacatgtaaccattgttttgtatgtagttctgtctagctttttttttttttttaa

SEQ ID NO: 14362 - DNA, 2148 bp, Homo sapiens
gaggggcggctaccggagtcccgcactgccgggactctgcagaaagggttctcaagtcaggcttctccggggtagccggggctgtgggtgcggccccgggggcggggcgagcacttgcgcggggagggacctgcaagcgccccacccacgccggggccgcagtaaccccgcgccgctctgcgcacgcgcggcttcaggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcggtaggagccgggacccggcgggcgggccaggggctcctcctgggcttcccggaccccgaggcctgcgaggcggcggcgagggggcggctccttgggcctcggggtagacgtctctttccttcctcagggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtagggaggcagtgcctgattttttgggagttggggccaggatgctggaggttaaaggcgacggtgttttcttcgacaagtgttacagtgccagagaaccgtggcgtttcagcggtttggattcaggaagcattgaggtggggagcacagggtccaatgaaatggtcacggaggtattgcaggcgcaaggttagaagacgaaatgaaaatgagatctgaggaagattcggctcctggggaatcttccaggagggaagctgagggtcttaccttttggaacgtaagagaatttatagagaatgcataaaaccccttggttctcccctcctccgcgccccccctccatctttgtagttacatctttctaaatgagtcgcaagtaaaacttaacggtaggatatgcttaggagagaaggaatgcagtgttgctcttagggctcaaacagtgtggattgcttaaattttgaaggcatacagtgtaaaagtagtgactaaagaatgtttactctccatgcaaaagttggttttagttttaaaacacttgcagtcttaaatttaagaagatacaatgtattaacttagttttttagatcagtttgaaacttccttatttttcaatagccacgcaaaagagattctccattgcttaaagaacaaatattttaaggaattggaggacctggaggtggacggtcagaaagttgaagttccacagccactgagttggtaggtaccacagtgcttcatgccgaatatttatttgggatattaatctctatcacttgaattatatttcttggtactgcatttgctgttaaagagcttgggtatactttgcaaacatcctaatgttctagtacctggtgcttttatcaacattatattgctacgcaagttttcatgcgatttgcgatttgcagctttatgagtcactgatttcagccagctcttcctagtacatccagcctcttcctttatgtcaccacttccgccagctcccttttacagcccttgttttctcacatcaaaactgttgcagagtggctgctttgccttcagaaaaaggacagacttagcttgacaacagtctcctggtaggtagtctcttagtgttttccattacagacaggttaccactgtctgctgtcaggttgtctcctggtacttcgcagtacagactgcaccagccaatgtagcatttccgagtctcagcacccaagcgtgctactactctgggagctacctctttcttgacctgtc

SEQ ID NO: 14363 - DNA, 2215 bp, Homo sapiens
tgccttcccaggattcttccttcagtgctgaggcaggtcgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccacggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttttgtgtttgtgtccaagtgtatgctttcaagggcaagagtggcttctacattttccgtattgaatttctaaattagggcagtgctttagccatttattctaaataagattcaagagaaggcagatgattccagtcctataaagcaagttgcagcagggagattatgttgtcactggtccattgaagtaggaggaggtaaaaatacaaaaattagccgggtgtggtggctcacacctataatcctagctattcgggagggtgaggcgtgagaattgctcaaacccgggaggcagaggttgcagtgagctgagaccgtgctactgcactccagcctg

SEQ ID NO: 14364 - DNA, 1128 bp, Homo sapiens
cccccagcctcgcacccctgctttgaagtttctgctctgtgcctcttatcttctggttcccaattccagttccctggagatgaaattgcccttaacatggaacatcacttcctggattctactggtaggagttttgtttttgtttttgtttgaaacggagtcttactctgttgcccaggctggagtgcagtggcatgatctcgactcactgcagcctctgcctcccaggttccagtgattctcctacctcagcctcctgtgtagctgggattacaggtgcacgccaccgtgcctggctaaatttttatatttttagtagagggatttcgcacgttggccaggctggtctcaaactcctgacctcaggtggtccgcccacctccgcctcccaagatagttttaataggttatctttctggtatattagtgagtaagattataggattttggattaaagagacccaggtttgaatcttaactttcagaatgaactctttgaccgtcaataaatcatttgagcttttcaagttttagtttcttcccctgtaaaatggtgataaaaatacacatttataatgctgtttcagagcttaaaagaaaaagaaaaaatagaattaggaatttcagcctcatgacagatccataattgatgttcaaacagtaactatcattaatattagttaactatttctttattatttcattaattattcattaaataatatttctttctaagggaaggaagaacttggacagaacactgggccattactgcttattttgatgggattattgaatttcaatcttactacctgtttgccaattaaaaaagcaatctttcagtcattttgacatatagtgtagtgatacagtataagcatttttctactgtcagaggccaactcctaaaagctggaaacaaacctctctgctccaagaaggtcttgctggccatgaggccacatgctcactgcagcttgttagggaaacccgagcttgttaacctcattggatttagatagcgcaatggcaatgctcctcaacctttccgtcattatcaccccactaatgagatattttagacacttcttctcagatcactcctatctacatacaaattcagatata

SEQ ID NO: 14365 - DNA, 1171 bp, Homo sapiens
atactattgtatgccaagcactgttctcggtgcgcttggagagctgtagatttaaacaaaattcatctttgcgaccctaaaatgaggagaaaggaggatgggggtggggggaataaataataaacacgttttagtctcatcaccaggctgaatttcactgagtagaccctggcccaggaaacataatagctttttacctcttagaaaaatgttctttttacattatattctttagttacgttcttcacatcactgagggttgaatgttcatctgtaaggggacacatgtcctattcgaccttcgctagaactaaaacgaggctttcttttaaaaatagagggcttctgcctctaagatgacttgcagcttaattctagaagctgcttctttccatgatagcatctaacttgtgctgattatactaaaagtgaagttttgttgtttgcctgaactgattgtctgctggcttatttgcagtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtgtacgtttcagtagatgatatgattacccatttgtagaggaggcagtttgtttgccatttcttaaaggcaacacaaaatgaccactggtggatttgtatcgatttgattatttgttttgattacttggttttgctttgtttttaatgtagatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgcttgagctcaggaattgaagaccagccagggcaatgtagtgggaccccatcgctacaaaacaaaaaactagccaggcatggtagcacacacttcagcaactccagaggctgaggtgagaggtcgaggctgcagcaagccatgatcatgcca

SEQ ID NO: 14366 - DNA, 1115 bp, Homo sapiens
ctacacttcattgagataagagtgactcttcctgagtgattacttacctttcccattctgttctgaacttgtaaaatagtaacagtattctgtaaaagtgctgcattctaagaagaccttaattcatgccagactacagtggtttcttgagtacattcataatggaaggaaatagtaaatttcagagttagcgaaaataaagatgtaattttttcctatctaagtatacagtcccctttagggcccatggatcacaggttaagaatctgccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccat

SEQ ID NO: 14367 - DNA, 1072 bp, Homo sapiens
tctcacttggccctgtcgttgacttactaaggctggaagacctggtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatggtgagaattcaactatttgtcctatactgttgcttattttgcttcatggtctggcttttttgcctgtgtgtatttaacagagacacagtcaccataagaaaaataatcgtggttctcaaacaatgacgtatcatggtgtaaaattactgaagaccatgttaaattgttaatttcacaaggcacatttgcctttctgctgtcccttagagtatacaatatacactatgagatttttatatctttttaaatacttaaacacagtttaaatattcaagtcctggattttagaatgtttgatacagttacattaggggttggttaaactgctagccctagcaacataagactcattttaattacaatatggtattattaccaaggatgacttacatctgtcccttaggtagaaaaagggaacccaagtgaataaccattgacgatctctgttctttgagaatgagtt

SEQ ID NO: 14368 - DNA, 1142 bp, Homo sapiens
tagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaagacagtaagtttattagattcttaagaagttgcgttgtaatcccattaaatagtagtcatatgcaaaatacaattcacattataaatcctgcctctttcagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctgtgagtatgggcagctgactccttggacatgcatgtcatttgtgactatggaataacctttctggaaaaagtatgttccatggcccactcaagaaaaattagttttaataagagacaatttagtaatatttgcaattgcatataatacttctaaatgaaatttttttttcttattgtccatcctttcatggagaatatatacatctttttgccctcttatagaagtttgctgctggtccagctttcatggagtaaatgtcttttttttttttagtgcattaaaaacaaaccagtttacctttatttagaccaactaacttacctttatttagtgctcataacctg

SEQ ID NO: 14369 - DNA, 1218 bp, Homo sapiens
ccttattaaaataagcttagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaagatgattatctgagtgcagtgat

SEQ ID NO: 14370 - DNA, 4204 bp, Homo sapiens
ctgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttc

SEQ ID NO: 14371 - DNA, 1113 bp, Homo sapiens
ctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaat

SEQ ID NO: 14372 - DNA, 1133 bp, Homo sapiens
cgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtg

SEQ ID NO: 14373 - DNA, 1121 bp, Homo sapiens
ccggtctgctcgcgcgtcggctgagcagcagcaggaggaggaggaggcggcggcggcggcggcggcctcggggccggcacccagagcgcagtccttagcgggccgggcacggggcagggaggatgcagactccgggttggagagcggaggagggcgggccaggtccgggcctggagaggcgggcgggggtgctggtggcggcctcggggaggacggccgggctggggacaccgacaggccgggggagcggccctgcgctgggggacgcgcgggaggtcggcggttcacgcttttccgtggcctctttgaaaatcacctccccagattcggtgagatcagttccccaatccgggtcacgaggagcaattgcagcgggagggcgatggtgagaggcagaagttagcagtgctggtagatacctggtttagtactgtcttctcttggttgtcttgatctttgctaggcggggttatttttgattcattttagcagattggttgtggctgggagtgacacagccgactgtccagtgttagcttggggttaatctactccccagtgctcactctccttgagaagtgcctgcagaaagcaaaggtttaggaaaacatgagctccttctaaagaaagctacccccccccacctttttttttttggtgcgactggccagatagagcagccccgtcttacctcttaatagcagaactgggacgtattcccttcatgccctgaagctaagtctagctttctctctacctacctgtcacagaataatagattctgtgcagaattcagctcctctctgttagaaaggctcttctgcgttggagatggattttttggtgtttgtgagaccaggcttttttacatctctattatgcatagtacaaaaatcacttctgctgctgctaagagccctccctaaaagacaccgaagatttgctgcctgttggcgtggctctctccaggagttgtcgtctgctcttggctttgcttaggcctgtgctgcccccgccgccagggctcctgttcatgttccgtttgggtcagaaccaggtaatgtctcactggcttgttcctttcttctgccctccaaaatgacaaacttaactttttagtt

SEQ ID NO: 14374 - DNA, 1201 bp, Homo sapiens
agtgagggtcaggtgccatccgtcgcagattataaagtcatcagcatagcttggagaatgttccttttgctttcctttcaagacttagacccatcttgttgataggaaagaaagaactttgaatgcagggcaatggggaaaaatgtgggggagactggcctagagagcagctgtgagggaggtggttgtctgaggtgagtgaaacacatggacgtgacaacttttttttctgtccaaaacataaaaactgaagaaaggagtttttcccaaaacattggaagaaaaagacaaggccatatgtagtaccttccatgtggcctgcagagctcagagattttctcccagatcccctgaagggatgacatgtcctcactgtgcctcagctgaaacaaggacttctgccctgtgcaaatttgtgtagttgctttaggaataattttgacagagtgaatggatgataacataggatttctgtcttatcttgtgtctaagtgtattcctaatgtttgttttttaggtgggagagataaacgtggaggtcccattttaacgtttccggcccgcagcaatcatgacagaatacgacaggaggatctcaggagactcatttcctatctagcctgtattcccaggtaagttctgtgtggcttgtgcttgtcactgatgtcacatttacaagagatgtggcgctatactcgttagaaatcagctaaattgtagcctgcattccaggcaaagtagtataaaatgaaagtcattatctttcaccttattaccattttgtgaccattattgtctagtgtaaagccctttggggagcagggacatgaaggtaggtaagagctttgtgtgttgacagtggatctgggatactcagctgggatttcaggatgtggcgcctgagttagaaagccattgttgatgattctaataccgtgacacagaggcctgggtgatcagaattgggtgctgcttttgacaatgcatttctgcctacttggcaaacgttagttctttaaaaatagtctgttgatatgtagcacgaagtttgtggggcattaaaaatccttattagctatatattgggcgtagatttgggaatctctatcaaaattgagactccattggtaatgggaatttttagcatagatgccaaagaacaccaagagcaagcaatgttgtgttttctggagagtccgca

SEQ ID NO: 14375 - DNA, 1760 bp, Homo sapiens
aatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattctcaaacccggtatggtggtcacctttgctccagtcaacgttacaacagaagtaaaatctgtcgaaatgcaccatgaagctttgggtgaagctcttcctggggacagtgtgggcttccatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgctggctatgcccctgtattggattgccacacggctcatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaaaggaatgatgtaaaattatagttttttatgaatgataatgaatttctagtgtgttagattctatcggaaataagtcatgattattttaaaatatctataatacaatggaaattatatcctttaaaactaagtttctcatagaaaattttattttattttatatataatgtacatattttgggggacatgtgataatacattcatatagtaaagatcaacttagtgtaattgggatgtccatcaccttaaatatttgttttttttaatgctagaaacattcaaattctcttttagctattttggactgtacaatatagattattgtaactactgatctatcaaacactatgtctcatttcttccatcaaactatatatttttacccattaatcaacatttcttcatccctcctcctccctactcttctcaacctctagtaatcaccagtcta

SEQ ID NO: 14376 - DNA, 1187 bp, Homo sapiens
acttgtatatcttctttggagagaggtgtctgttcagatcctttgcctaatttttaagctggttatttggttttttgttttgttaattgttgtaaaagttctttattctggatacaggatccttatcagacatatgatccattcttgattatctgctttttttttttttttatttaaatcgaaaaggattggggctgggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagatt

SEQ ID NO: 14377 - DNA, 1380 bp, Homo sapiens
gccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaaaaaaaaaatattttaaagat

SEQ ID NO: 14378 - DNA, 1119 bp, Homo sapiens
actacgacagagagaaaggagaatttggaggttttggttcagttagtggaaaaattgaaatagaaatcaagatcaaccatgaaggaaaagtaaacagggcccgttatatgccccagaacccttgtatcatcacaacaaagactccttccagtgatattcttgtctttgactatacaaaacatccttctaaaccagatccttctggagaatgcaacccagacttgcgtctccgtggacatcagaaggaaggctatgggctttcttggaacctaaatctcagtgggcacttacttagtgcttcagatgaccacaccatctgcctgtgggacatcagtgccgttccaaaggagggaaaagtggtagatgcgaagaccatctttacagggcatacggcaatagtagaagatgtttcctggcatctactctgtgagtctctgtttgggtcagttgctgatgatcagaaactgatgatttgggatactcgttcaaacaatacttccaaaccaagccactcagttgacactcacactgctgaagtgaactgcctttctttcagtccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcacagaccgaatgtctaggatttaagtaaaattggagaggaacaatccccagaagatgcagaagacaggccaccagagttgttgtttattcatggtggtcacactgccaagatacctgatttctcctggaatcccagtgaaccttgagtgatgtgttctgtatcggaagacaatatcatgcaagtgtggcaaatggcagagaacatttataatgatgaagaccctgaaggaagcatggatccagaaggacaagggtcctaaatatgtctttacttcttgtgattttagactccccttttttcttctcaaccccgagagtgatttaacactggttctgagacagattttattcagctatccctctatataataggtaccaccgataatgcta

SEQ ID NO: 14379 - DNA, 1623 bp, Homo sapiens
atgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtatttttttatgtgtatgtttctttctttaaaacaatattcttggatataaagtagaaaagtttaaaggtcatttccatttcttcactaaggagaaaaaaagttaaataatccaagtaattaaagaatataagtcactagatgaccttacaggaagacgaactcaagggctgataatctgtggtggtatgaacaataaatctagaataaaatgttaataactacaaattaaaaggggtgtgaggatgggaggaagttggtagggtagaaaaat

SEQ ID NO: 14380 - DNA, 1296 bp, Homo sapiens
tccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcctttatcagaggaggctctaaaaaccatgga

SEQ ID NO: 14381 - DNA, 1211 bp, Homo sapiens
aaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcggtaagtacctgcctggcgtgtcccagtgaaatgggtggccggtcacacccacccctgttgcatcctcaagttgaatgaagatacccgtaggatatctgtgcaaagattgcagagtcgtggtcttagagatcatcttaaaccttttgcttattccataagccaattgcattcataagtagaactttgatgtgcctgtttcagttttagcacaaagcctagagctgagctgtgcccaagacttcagaaaactggctatttatttatttattgttgttgttgttgtttttgaggtggagtcttctctgtcatccaggctggagtgcattggcaggattttgcctcactgcagtccccacctctcgggtccaagctatcctgctgcctcagcttcctgaatagctgggattacagatgcccgccagcaca

SEQ ID NO: 14382 - DNA, 1162 bp, Homo sapiens
cggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaa

SEQ ID NO: 14383 - DNA, 1976 bp, Homo sapiens
taaattaagcaatgatgcatcatgatgattcttccattactggaagtcacattttatctgaatttattctcatgtccaaatgtttgtgacgtatatttaatttgcttattgccacatgcacagccacacacagaggatgacgtaaagcaatcatagaaattaacaaaaagacgtatttttattactttatcagtatttcaaattgatttttaaatcagaaaaaaacaggttatttgaaccagacatagattggctgtattgctctcataatttggcagatgtctgtatgttccatttatagtacaactgccacatttatttgctttttaaaagtgatatattagcactctgtccctcactcgccgccgacaacctgtctcgccgcgcgcatgccctgcagccgccccacagaaatgcttcggttacccacagtctttcgccagatgagaccagtgtccagggtactggctcctcatctcactcgagcttatgccaaagatgtaaaatttggtgcagatgcccgagccttaatgcttcaaggtgtaggtagaccttttagccgatgctgtggccgttacaatggagccaaagggaagaacagtgattattgagcagagctggggaagtcccaacgtaacaaaagatggtgtgactgttgcaaagtcaattgacttgaaggataaatataaaaacattggagctaaacttgttcaagatgttgccaataacacaaatgaagaatctggggatggcactaccactgctactgtactggcaggctctatagccaaggaaggcttccagaagattagcaaaggtgctaatccagtggaaatcaggagaggtgtgatgttagctgttgatgctgtaattgctgaacttaaaaagcagtctaaacctgtgaccacccctgaagaaattgcacaggttgctatgatttctgcaaatggagacaaagaaattggcaatatcatctctgatgcaatgaaaaaggttggaagaaagggtgtcatcacagtaaaggatggaaaaacactgaatgatgaattagaaattattgaaggcatgaagtttgattgagggtatatttctccatactttattaatacatcaaaaggtcagaaatgtgaattccaggatgcctatgttctgttgagtgaaaagaaaatttctagtgtccagtccattgtacctgctcttgaaattgccaatgctcaccataagcctttggtgataatcgctgaagatgttgatggagaagctctaagtacactcatcttgaataggctaaaggttggtcttcaggttgtggcagtcaaggctccagggtttggtgacaatagaaagaaccaacttaaagatatggctattgctactggtggtgcagtgtttggagaagaggggttgaccctgaatcttgaagatgttcagcctcatgacttaggaaaagttggagaggtcattgtgaccaaagacgatgccatgctcttaaaaggaaaaggtgacaaggctcaacttgaaaaacgtattcaagaaatcattgggcagttagatgtcacaactagtgaatatgaaaaggaaaaactgaatgaatggctggcaaaactttcagatggagtagttgtgctgaagtttggtgggacaagtgatgttgaagtgaatgaaaagaaagacagagttacagatgcccttaatgctacaagagctgctgttgaaggaggcattgttttgggagggggttttgccctccttcgatgcattccagccttggactcattgactccagctaatgaagatcaaaaaattggtatggaaattattaaaagaacactcaaaattccagcaatgaccactgctacgaatgcaggtgttgaaggatctttgatagttgagaaaattatgcaaaattcctcagaagttggttatgatgctatggttggagattttatgaatatggtagaaaaaggaattattga

SEQ ID NO: 14384 - DNA, 1138 bp, Homo sapiens
atgttactttcctttgcctttttttccttccccacttttatcttttgattctcttcggtggcattgtgcctttaagctgaggtgtcagacctggaaaactttggaacaataggagaatgaacccatgcattgtgtttatgtggtctggaatagggtagggggagcattgggagtcatcttccctcagtgaggaaggaagagctactgtgtagttatggatgccccaccaccaccaaaaggtgatattgaaagcataaaatgttgactccagtatatctacacacttgcttttgcagggaaagtgttaatagtatggaagcgagtctgagcatactaaaaaagtagaacaaatactaaattaacattgttaacgtatgatctaatctggatcttagaaattgaaagcttcaattcagagtgtataaaacctgtaaattaaaaaattagtatagtgtgatagcttttcactcaagattttggaatttaaaagctctacatatggtggtggcacctatttccccagatggtttaagaattcttactattctttgcctttatttctgttttactttgggatatatgcatatatgtaaacatcatatgtatcctcatatacttatttttatatatgtatataaaataaatgtaagaagtggttgaactctcataagaggctttacagtaagaaatgacattaattcagagtactttaaaaatattttattaatacatgagtgcccaaagttgttgcaaatgttcattttaatcacacttttcatatttgctctctaccagttgttaaaggctcattgttggagcaccacctgtctagtggtataataatctccaatgtacattgaactctgttttaatgatgctcattgccaaaataagttggtccctagaaaacacagtagtaaattactttaatgcagtagtttttaaagggcagacccagaccagcagcatctgcatcacctgggaacatgtcaggaagacggattcccagtcttgattccagacataggaaatcagtaatcttgggggcaggacccagctgactgctgcgtttaacatgcatgctggagtttgagaaccattgttttactagatatatatattttctaccagctgttct

SEQ ID NO: 14385 - DNA, 1208 bp, Homo sapiens
ctggatattagtcctttgttggatatatagtatgcaagtattttctgccattctgaaggttgtctgtttacagatacttggggagataagatggaaagatcagggcttagaattcaactggatagacagctccctttcctgcttaatttgggatgatacaaagatggtgctcccatgctgagtttttgttttgtttttgttttttgagacagggtctccctctgtcatccaggctagagtgcagtggcatgatcatagctcactgcagcctcgacctcctgggctcaagtgatcctcccacctcagcctcttgagtagctgggactccagtcaggtgccaccacaccagcctaattttttattttttgtagagatggcgtctcactgtgttgcccaggctagtcttgatctcctgggctaaagtggtccctccaccttaggattacaggcgtgagccactgcacccagtttatgctgttttaaagactgaacttatttcattgaaattttagctggccatgactcatccaagtcatcatttaaattttggaatgaatcctgatcatgccaggaattcattatctaactgtggaattcggcagcccaaatacggagacagaaaagttcatcacatgcacatgcggaagaaaggtatgtctggatgattttaagatgtgaatctcctattttggcctgtgttttctgttgtaaattatttcgcctctaggaatggttccctgggtgactctttcaccgtctcatattctagtgcttactgactctttttttttttttttgagacagggtctcactctgtcacccaggctggagtgcagtggcacgatctcagctcactgcaaactttgcctcctgggttcaagtgattctcctgtgttagcctcccaaatagctgggattacaggcatgtgccaccatacttggctagtttttttgtatttttattagagacagggttttgccatgttggccaggctggtcttgaactcctgacctcaagtgatctatccgcctctgcctcccaaagtgctgaagttacagacctgagccactgtgcctggccccacagactcttttataatacttactttgagcaagaactataataagggttgatgagttttttagagaaatttctttttcctatccagtgttttaaataattgtttatcacacttttagacaggtag

SEQ ID NO: 14386 - DNA, 2071 bp, Homo sapiens
agctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcatgtcatttgtgtttttgtattctcatttagttttctttcaaatgaaatgttacttactgtagcattgtaatattttaatgcagggcttgggtttcttaaagggccagatagtagatattttaggctttgtgagccgccagctgtgtcagttgcaactactgaactttactgaatgaaaactgttatagataataca

SEQ ID NO: 14387 - DNA, 1175 bp, Homo sapiens
aggtccactttcaaaccatttggacgcacttgctccttctaaagggttagggagtcccggcagatagcgtacccctccccgcccagcagcagagagcaaagtccttcctgccgatcctgcagaccccggagtccaaatgggaccccgtccacacgaccgcggagtcgcctccgaagacggcggtgtctggggcgtggagggcacggctggaggctgagtggggtccaccttcgcgtggcccaggctcttccattcacggggggccccgccaggttcaggctccagccctgggtagtgaaggggaaacggggaacggaaggagggagggcacgtcacgggagcaggactgcaggaccgcgggtcagggggcgcaggaacgccaaagaaaagacaagcaccgagggccgggaagggtgtaggctgcagtggcagcggatccccggccgccgcttccggcgcctcccggcccagctctcccgcgccgactctgccacatcctccggtgacgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgaggtgcgggcgcggcgggctgggcggggggcggcggcgcggggcccgggcgccaggtgagctccaggtaggtgccaggtgagcgcccgaggcttccggcccgcgcacctgccctcgctccgaagtccgcgcctggtggcgccca

SEQ ID NO: 14388 - DNA, 1242 bp, Homo sapiens
cgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaa

SEQ ID NO: 14389 - DNA, 1097 bp, Homo sapiens
tcatttatgatgttctccagactactaggtgctgagtgggtccacattctgggacagtagggggtctcagcaggggtcctagctgtaaacccaggagttgactgtcatgaaagcatgtctctagtcatttccctttcatcttttataagctcaactttcagagtgggttttctttgggccactggaatcagttctgccaacagtggccagtctgttcttgtgcttactccagaggagtgaagcacgctgactgctctcagagagccagggcccctgctggaagagattgggcttcctttggcagtcacttaaaagtcaggcagcacctttcctctcattcttgggaagtatccctagaagttgatcatctacttcatttctttagcattcacttattgctgtgtaacataatttcccttcctgatttcattgctgatctgtagtgtttgatgagaaaaagaaaactctctttggacaactgaagaaataccctgagaagctcatcatccactgcaaagaccttcgagtgttccagttttgtctgaggtacacaaaggaagaggaagtcaaaagggtaactagttgcatgtgtttttaggttttatttcccatcaggttttccccactagctctagtttttgcttacgttgcatgaaggttgaggggaggctttcactctgtgaacttgaaattggttgtaatcccatattctttgattagaacgtgaaaagtaatttgataaagcatgcgtgtgtatcatcttggcacatgctacctttaatacttcaattcataatgtttttattcctggagccactaaatggtgggaggtggtaaaccaggtcagtaggcggtaggggaaaatgaagaaaggatgagacagctaaaagtttatccctattctcccacctctgacagtctttccaaaagacagtagtgttggagaattccaacttctatgagtaaatgagtttacctctgggaggtagtagttgtgcatggaaaggaggaagtacacaggtcagatgagcaaagccaaataatcagacatgcttttagagactaaataaacataatctcctggtcgccacagcaag

SEQ ID NO: 14390 - DNA, 1196 bp, Homo sapiens
ttagggcagactggggcaagcccatctgtgttcacttagggtattgcttctatggaacatctgcttgggtcaaagtaatgaaaacactaagatttctgcgtgaaagtgcagctcagatcattagtacctatttggaaatttccattattcccagtgagaagatagagaaatgtcctgcacagaggtgtatctgagccatttcaatttcacttcttggtggtttccactctgccgcatcttctctcttatgtttttgcagctcctgccatgctgaaaagtgtaaagttctaaagccctgtgttgtattgtatgtttgtccttatgtaaatagggctggaaagcctttagtgtttgcatatcgtatgttccctgagaactctaaggaggacctgttttggtttctaccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgtatgtatgggctgcatttggcagagtttgtgggcaacagtgtggttgtggttccgttgtctttttttcccagcttctcagttactctaccccctaacacacataaacacaaaggacagaaatcctgaatgtatgaactgcatttggtgaagtttggggggaatagcacagttgtaaaatagctctgttgtcttttttcccccagctactcagttactccacttcccatcatccccaccctccccaccatcccacataaatacacacaaaggacggagtccttctcatcactggcctgctctctgtcgttcagggtctcctttccgtggcaggaccgttaagaaatttctcacccgtgcctcatgtcatactggcttacttttgacctcatgtgtcaactttcaattttcttctgtatttcagtgcaatatatatcactcactggaataacatcttccaaatatactagttccccacgttttctctatactaagctcttccttaaacccaggaactgagttcagtaatgaaaccgatggtgaatgcagcctttgaatttgggttcactctgtttttgttttgttttttatttttaattgtttttgagacagagtctcactctgtcattcaggttggagtgctgtg

SEQ ID NO: 14391 - DNA, 1169 bp, Homo sapiens
gtatttaattctttttctactttctttttcttaattcaaaatagcttttttaaaataagttctttaaggtacatttccccaaaacaatacaggctttattctgttgctttttattttattccagtttattgaggggatataaatctgtgcaagtttctgactgatccacgttatttggtaaaagaattctataactttttttgatgtttttaaatgtcaaaggctttttttctatagtgatgacttaaaccttatctcctcttgtttttctcttcttggtgttatagattcagaaattttatttttagcttagcattatgcatattctcccccctcctgaattacttcacagtctcatctaggtgtgggtgtgcagcggtgagttcacagttaacttctctgagcctagtttcacaaactagacaaagatcatttctagctcccaactcttgtgcttctagactctgtgatctggtataaaccagctgattatggcacaacatgccatgtttgcagagggcctcaccaggaatgttgtattagctagtgcatgctaatttctggtcgctagtacatgagcatgggacggggctggcctggtcttggggagagcctcaccattaaaagtatttcaccattaaaagtattgggaggtgaaagcacaggaagccttgcttacatgtcttcccccatggacttggcagagacactttttctgggactattttaaaccctaatgaggccctgtcttcattatttccttcaaactgtgatctcttgagaggctgacctagtgactgagccatcttccggtatttccttagtgtttcagccagaggtaattaaccccttgaaagatgagagaacagcaccataatatttgtcccttctgagtgtctgaaactgttcgttttcatattgaaggtagactaaataaattttgagccaaaaagtaaatttaaagaccttgaaggagctatcaagtgggagattccaaggagaagatggttatctgttgcatgagaagaaaaatcctttgggttttttttgttgttgttgcaaaacatttatacttagtttttcatttcccccatagtcttctcttttgcctgcccccgtgagctcctctgcttccagatggcagagaatactgacctattccctaatcc

SEQ ID NO: 14392 - DNA, 1881 bp, Homo sapiens
ttttcaattaactcaaaattctgactctctttgttgcagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttattgagtactgcatcttgttattcctgacaaatgtttgttgtctaagcacataattttcagaaaattttgtaattcaatactatattggcttaatttctttctagggtcagaatctacccccaaagtcttagagggtcagaatcttcccccaaagtcttagagggccaggaaactgtaggagaccacaggggaaatagaacaggagactcagacttttctcccagattcatcacacacagattatctaatcta

SEQ ID NO: 14393 - DNA, 1150 bp, Homo sapiens
gtgacactccgtctcaaaaaaaaaaaaaaaaaaaaaagaaatgcctgttttgggttcttcatttttttcctataactgtaactatattgagcattctatatttatcatcagttctttgttatattagctccagaataacttacgaccatttagagtactgaacaaactcagtagtttattgtacatactcattaaggtggatttttgtgttccctcttgtcttgttgtctttgtgctagtgcactgtgtccagtaatctttccttcggatttcgttttggtgggtagggtttatatttccagaaattgtttattatattactaaattaataagttaaccttttgttcctcatattggattatgtaaatttattgaaaataactccgtggatatattaaagtgccaacaagctctcaaatggctcatgtgacactgatgctaccttaaggaagtgtcttgctcacctggtcaaacacccattcctcactgcattttgccaattcaatccattttagatgtaacctcgggtatggtgaaagacccaccggacgtcttggacaggcaaaaatgccttgacgctctggctgctctacgccacgctaagtggttccaggttcggaacatcattttacttttttcttgtagccttatgagagaagtagttcagtacaacatgtttaactgtgcttaaacatttcaaaagactgcccaagcaatactattttaaattaaatatcagaaaatatgttaacatagaaagctgggtatgatgatctgcatattgcagttattattaatttgacaatgaacttaggtttggggagtgttttgtagttggggtttttttattttttatttttagtggctatatttaaagttgacttgtttaggaacatcacatgtttgtgtatatatattatattccataaggctgcagattaactttgctttaaataatggaatatgtgtttaaagctttgtgtatagttttaagatttttttccccctctttctctaagttaataagtgtagggagtgaaaggtgaggaagcagctgtttggtttagtgactttgcagtcatgcaaaggcacagaagggaaaccaaacagatttccttaacctttcagtccctagacaaactttttagct

SEQ ID NO: 14394 - DNA, 1146 bp, Homo sapiens
tgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaagga

SEQ ID NO: 14395 - DNA, 1438 bp, Homo sapiens
taaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcatttctggtgttgatttttggtgtattcagaagcatatctgcgtggcttctgaagatcagttcaatagcatttcagtgtaataggttttctagtctgtgctatgctcagctggt

SEQ ID NO: 14396 - DNA, 1158 bp, Homo sapiens
tataagtactaatagatttcagaaaatattgatgatttgccatttaccaagtttcacccccaccttgattttatggattatcaattatttcaggcacatttataatgaggttatagccagtataccttttgggaataacgtaaccaaaccaaaatgaaatgtttcctttttattaaagatcatagaagaagatgctgctcttgtagaaataggacctcgttttgtcttaaatctcataaagattttccagggaagttttggaggaccaactttatatgaaaatcctcactaccagtcaccaaacatggtaagcggttgtgtcattcagtagtcttcaatgtaccagaaccctttggccaaaatgattctgtgaagtaattgctgttttattacctgtgaaactgaatttggtttttgctgcatagaaacttggaaattactcccttttttcatgacactggctgaaaggatatatggttcataactgaaagtctttgccttatataaaatgtttatttttatttcaaaagcatctaatcttttttttttttttttagcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatcagttaatttctgatttctttttgaagtttgtgttgctaaaaatgtagcacacttaatgtagcctgttctcttgggttggaatttttggtttagcaaagctgaaattcagacatttattaggtcatattatttgtaaaagcattcaacact

SEQ ID NO: 14397 - DNA, 2295 bp, Homo sapiens
ttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatat

SEQ ID NO: 14398 - DNA, 1238 bp, Homo sapiens
tggatagacttactctgaattgaaggtcatatagactacacttaagaacacacacatacagtcttttcatgtgaagtgtggccagaaagcaataagccaggagcagagataatttgatcctctttgtaatttaatgattgactaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaa

SEQ ID NO: 14399 - DNA, 1201 bp, Homo sapiens
tctgaggtgctacctttgtaatatattgtttgcttatatatactggtgtttaattttactttttgcttttgtgaatgggatttttttccctattatttttccagcctgctattgctgatacatagataagctaaagattgtcattttacacagttttctttttcggatgattctcttgggctttttgggtagaaaattttatgttccaagatgatcattttttctttctaatagtgtgtggttctaattgcattgccctgaacttccagcatgatgttcaatgatagtagtgataacaaatatccttgtcttgttcctcatttaatagtgaccatcatgtttttttgcttttcctagatctctctactttagttagaagatgccccaatcttgtccatctagacttaaggtatttttttatttgtttattttagatcaaaagttgaaaaatcttgatttctcattaaattgggaaaggatcataatgttgaagcaactaaacagtaggttatttctgtcttctttatctaggatcaatgtgtgattttcaatatcttttcttctgccttcttaacagtgatagtgtcatgctaaagaatgactgctttcaggaatttttccagctcaactacctccaacacctatcactcagtcggtgctatgatataatacctgaaactttactgtaagtatgttttgtttttaatgcttaatagaaggcaggaaacaacagagatgccccttggtgtgaaaatccatttttattaatagacatatgaaaccgaaacattagtaataagtataccacagactggctatgaaagaccagcagagtattgcttaaactggtgaaattgagttgatccagattgttcactaaacatttattgtttagctgtaagcagttttaattactagcttgctgtcttagtatctatgagaagacttagcagagaagcagaagataaccttttcctccaggaaacttgaagtgtaattgggaaggcagacccaatgtgggttagtgtctttttttttttttctttccaaatttttcggattaactccagttgattccaaaactttcatctgggcttaaagttctgtatcttctagtgatgtaagtcctggatagtgaagaaattggaaagatataagcctgtagatggtatgtattgtaagtctgatactgtttttgaac

SEQ ID NO: 14400 - DNA, 1120 bp, Homo sapiens
aaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggctttttttttttgatatacataagataccactttataaagaagctccatactatagaacctcccctaacaggcttaaaataccttctttttttttttttttttttttgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtat

SEQ ID NO: 14401 - DNA, 1130 bp, Homo sapiens
caggtgttaggaatgattgtcaattttagtactaagtaagattttaccctttgtcattaatttttgctttgttatcacagcagcaagcagaatttataaagtctttaaactatcataatgtttatacccaaaacacaaaattaatttatatgcagttaaagtcataagctaaatcttaaattcggataaagcacacaaaggatataaagataattataactttgtcagtagggtgtcatctagtggtgaaatgaggtagagtatatcacgtttgaaaacattgaaacacaaatcgtgctcaaagtagtatcagtatttgtacctcattctggatattcttaaaagaattaacacacatcataacacttttccaccagtgaaaatcaaatcataattttaatgtatattttaaacctataaatgtgtttatttccatttcattaacaatactgttttacagaataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggttagttcgtataatatcaaaattattgtaaatttttgccatgttagatgagtcaaaataggacttaaaatggcaccaaaatttttgaatcatataacttgtaataaacactgattttgattatggatttgactagaatatagtacttgttcaattataatttctttaggaacatttatatataatagaagttatttctacttgtcagggaaaatctcagaaaatactaccttctggtttcatttatcacttcgccctaattttacccaaaatagcagttgtctacaaaatggattgattcaagataaatactccttttcttgttcttaacctttataaatgagcaatgaaatgtatacatttgaagggagtaaggtcatacctaagtatagttcctgaataatgaacttgacgatctattgtataactgcaaattaa

SEQ ID NO: 14402 - DNA, 1149 bp, Homo sapiens
aattatgatttgaatgatactaaatatctttgattcaagttacacatagcaaggttttaatggggctacaggttctgcaaatgaagcaaaacaattaaaaaacaggtttaattggataaacgaaaggctccaaagtatggactatacacttaacacctgtactgatttttaagttaaactttgaatcattaggaaagatcctttactcatttatatacagattaaagagaggtaaataatagatttgttttcttttgcatgttttcatgctatttttaattaaattttatgtattctaaaatttacaaaaatgtcaatgtttgcttggcagatcctacgagttcttggtgaaaatgcaattgctgttcgaacaaaagccatgaagtgtttgtctgaggttgttgctgtagaccccagtattctagcaagggtaaagagcaaaaatgattctttcttttctactcgaattggaatattcactctatttaggtataaattgtttttttctcttcatttttctttagcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggtatgtttgtcatttttataatgattcgtgaatataattttgcctttcaagcatcatgttttgttttaaagtgttaagttagaaaaataaatgtaccaattatatatttatattgtcaaatttatgaactattgccactttctaaacaagtacatattttcaagaatagcccttgcaatatcataaaacaaatcattggtaataattggattccttttttcagttgctgtttctttttaattataccagtttacaatgagtagatgataggaaccacatggggtagttaaatgtttttgaacaagaatctagagtgattttatgtatatatttatgtatgtatatatataaacaggaagaattatttcagtgagagacacgtacagaacgttggtacctgacaatatttttggatcccttaggtgcatcttcttgtttccttaaagctgattaatgatagctcagatacctacaagtt

SEQ ID NO: 14403 - DNA, 1096 bp, Homo sapiens
ttttataactatcttttattactgtccttagaagaaaattgtttccctttgaatgatatttcagaaggatttttttgaaggagtggttgtaggggagggggtggatattatatataattttatttagttttagaaactatcccctaagattacatatccagttgttgatataaagtcaagaggtttataaaatattagtttaaggaagctttttcaagctgttgaatggagcatacttatatttactagtggcattttgtttttattgtttatcaaacgattttttctttcagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgataggtaaggttacataagcagtgagagaaaaaacttcactctgttcaaataataaatatttgggctgggtgtggtggctcatgcctgtaatcccaacattttgggaggctgaggcgggcagatcccctgaggtcaggagttcgagaccagcctggccaacatggtgaaacgccatctctattaaaaatacaaaaattagcctagtgtggtggtgcacgcctgtgaccccagctactcaggagactgaggcaggaaaatcgcttaaacctgggaggcggagattgcagtgagctgagattacgccactgcactccagcctgggcaacagagcaagactctgtctaaaaaaataataataaatatgaaacccagttttgtttgcatgcttactttaatgttagaaatgttccttttttaaaaaggagtttattctcttctattgctggatagtattctattgtgtaatatgccataatttatttttattaaagggaaaaaaacatattcctatacttggtgataatgcattac

SEQ ID NO: 14404 - DNA, 1125 bp, Homo sapiens
aaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaaggccttgtctgaatgttgtaatttaggtgtgactccagttctgctagagataagaacttcatttttgttttaagcacatttacatactagcaatatgttgttatatatactcagctcacaacattgaaagtacatgttttaaaagggctgtaggcttccatggttagatggtctgttagagtcagaaatctgaacactgtccttttattcacacagcatgctttgagaggttttaggaattccagccccacaacagatgcttgcaataccttttggggggtaagattcctaagagagaagaaattaggtcccctcatttttaccc

SEQ ID NO: 14405 - DNA, 1097 bp, Homo sapiens
ccaggcgtggtggctcacacctgtaatcccagcactttgggaggctgagatgggcggatcatgaggtcaagagatcgagaccatcctggctaacacgtgaaaccccatctctactaaaaatacaaaaaaattagctgggcgtggtggcgggcacctgtagtcccagctacacgggaggctgaggcaggagaatggcgtgaacccaggaggcagaggttgcagtgagccgagatggcgccactgcactgcagcctgagtgacagagcgagactccgtctcaaaaaaaaaaaaaaaatcttcaaatggaacccacctacacccaagttttcttttttactttatttcttatttacttaatcacatggtctttcctctcctgtgagaattaaagttgccagaagttggtggggaagaagtcctgcaggaggaaatgtttgtaaatgtataattaatcatgtgtctttttcgttgtaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaataca

SEQ ID NO: 14406 - DNA, 1235 bp, Homo sapiens
cacctcagcctcctgagtagctggtaccacaagcacatgccaccacacctggctaatttttattttttgtagaaacagggtctcgtgatgtttcccaggctagtctcaaactcttgggcacaagcagtccacctgccttggtccctgaaagtgctggcgttacaggtgtgagccattgcactcagtctcacctgtctctttatgagtgctaatggtctaatggctgtctaacatataattgctgtgaccctttatttttgactgcgtaagacggttttttttaactttcttaagataaaatatttggcattaaacatttaatgtttgaactacaaatttaaaaaaattaaaaaatacccagttgttaataggagaggaaaagtatcctgagaaatgaatactatttccaaagtgtgctcttcattgcagcagaggcaaagagtttctgtttctgtattttcagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaagtaagtatttcagtggtaatttaagaattcggtggagtaatatctttactgtagagatcagttctgctaaactgtttttcatgagtaagagccaatttaaaaactgaggaaaggccgggcatggtggcttaacacctgtaatcccagttacttggaaggctgaggcaggagaatcgcttgaacctgggaggcagaggttgcaatgagccaagattgtgccactgcactccagcctgtagacagccagactccatctccaaaaaacaaacaaaaaaccaaaccgaggaaaaaggccggtacagtggctcacacccgtaatcccggcactttgggaggccgaggtggacggatcgcttgagctcaggaattgaaaaccagcttgggcaacatggcgaaactctgtttctacaaaaatgcaaaaattagacgggtgttatggtgcgcacctgtggtcccagctactcaggaggctgaggtgggaggataatttgggcccaggagatagaggttgcagtgaggtcgacagatggcactccagcctgggcgacagagtgagaccctgtctcaaaccgcccc

SEQ ID NO: 14407 - DNA, 1301 bp, Homo sapiens
gagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgt

SEQ ID NO: 14408 - DNA, 1190 bp, Homo sapiens
tactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatcccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaa

SEQ ID NO: 14409 - DNA, 1233 bp, Homo sapiens
tggaggcctcagtgccaccaggctaggttcgtgccagcaggacatgctaactcactctctgtcacgtttcctgatctgtctctacctacctgtccccaccaccgccaccatatttatgtatatagagaggggttgggggacaggggaacagagacaaaataagcaacaaaatgtgttgggactagtttctggtatttagctttacttttctcaactctttttttctaattttcttcggcagaaaagccctaaacctcatgtacactggaaccagaattctcaaggttgagaaaaatacaagtcaaagtacatgtgtgaacactcatcttcacaaacaaggcctttaaaagctcaggggcccgtgttgacaggactgaactttgccatgtggggccccaggctcaagttctgcctgtgctttatgatggtctaagattgaagtcagcatatgtgtaaagaaatagaaccagatatttttctttccattcaacagtcttacagatttattctgcatgattacttttctttagcagaagggtttattgactttttaagtcctttaaaataattagtataggaaacaaactggtcacccttgggcaggaaggatactgcccatgagcatattttgtctggcctttagaatgtgtaaaacatatgcattattttctcacatttacaaactttggtgtttcatttaaaatgccagatttctacctcatctggaaaaatcagcatatttggcaaaatgaggctggtggctgccacttttatgctaggcagaggggctgcagtttgcacctgctgtgaacacgtttgttacttgctttgcccctgcatatttgcatttgcaccctgttgctgcatcctaattttgaaagttagctcctgaaatcgtataaaaatttgtgctcctctaaggaataaggcattgacaggggaaaaaagtgaattctgacaatgtttctatcaggagtgagcagagaaaagcttcacaagcatcactttttttctgaaagtacttcggaaggctctgttcatgtattgttctggcccacagtaagtccatttgaaagttttgcttggtggggaagtctgatgtgttataagcacaatattgtattgcccaaatagacttgcccagaattctctgtgtaaatgtatcacaccagaaagtcttctttattatcctgcttaagttaagcaggcttcagtgacactgccgttgatcct

SEQ ID NO: 14410 - DNA, 1151 bp, Homo sapiens
cactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttagcacaaaatgcaaagtcttggggcagagagggggagtgaaaaaaattttataggtaattgttacaaaaatacctgtcagaaaccctaaagctgcattgtaaaacaaatggtgtaaactagttttgaaaagtggtaaggaattgtgaaaaaaatctcagacttaatgctctctaaccacatgagtttcttcttttttatttagtaatacgctgctacatatttggaggttctggtgtttgtaggtcactgaacagacattgaaatctgatttatattgtataactgtaacatagaaagaaaaagtatttatattttttctgtaagaatatttcattgagttgtgtataatttaaataagatttgtccccaaatggttttgctcaccttgattttttttgttgtgattttcttgtttttgtataatgtgtatagtttatgtcaagggcattaaaagcctcctgaagcataatcttatcaaagggatacattgttaataaaatgtacttaaaattcttaaactttgtcattgttttatttgaaatcttaaaataatcagtggtcatatggccttgatttgagtcctgtaatgccgatgctgacacacgtgactccaagcaaaagtgacttttaggtaccacagacatgtagagtggctgttacaaatattttaaagtaatactcttcttaaacacttcataattaaacatctttgtagttttttaaatatctaaagggatttggaaaatgggtcagtctttagatagaatagctctgaatttttttaggaaataatgtacaatatgagtgatgatgatatgacagtggtgacttctctgtggaaggtatttgatttctcacacataaactgccctgata

SEQ ID NO: 14411 - DNA, 1092 bp, Homo sapiens
attttttccctagatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaa

SEQ ID NO: 14412 - DNA, 2698 bp, Homo sapiens
cccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaacgcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccctcaaaatgcttattttagctcatactcttctatgcgtgaagagaaaaatgcacccattattttacaaggatgtgaatactgatatacaaacatagactaagcttgttaattttaataacaaatctttatgaatctgaagagaattgatgttcatgataatgat

SEQ ID NO: 14413 - DNA, 2385 bp, Homo sapiens
tgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaata

SEQ ID NO: 14414 - DNA, 1048 bp, Homo sapiens
agtgtccagttttaaagatagcaagacagttcagggctttgtagacacccataggtgtgttcatgtgctgaagcaactttctttgcatttagggtcataacgtttttgtgggcttaatgttgagtggtctgttagtacaatataggagttaagagcttgaactgaagccaggcttttaaaagtaggatagttgacctttcttagagtagatacttcttagagtagatacagatgttaaataagttaaaatgcaaagctcttggtttagaaaatgtctgccattaaacatgctaattgttttttccttgcttagtgaaagtagttgggatctattctcagtatagggaaccattttcacaaataatctgtgatctcttgccaaatatgaacaaacatactggcccaatgactagtatagccaaataagtttttgagcctttattgcagttgcagttaactatatccgaaaatgggtatctttaagcaaagtgaagaatttcagcttatcagtgatgttgtaaaaataaatgtctgaacatatgaatgcagtattgatttcagcatttaactgagataagcgcattgaaatctgtttaacaaaaattaaaatgtatgcatcgatgttgctgaagtaacttgttcttgtttttgacatcctgcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagat

SEQ ID NO: 14415 - DNA, 1048 bp, Homo sapiens; identical to SEQ ID NO: 14414

SEQ ID NO: 14416 - DNA, 1633 bp, Homo sapiens
agggccagccccgcattccaggttctccatgtgcctagaagacagtaatcgacggtatagcaacagatctgactgctaacgtgcgaaaccgatcagtagtagcagtagcaccagcaacagcagcacgaaaagcaaaactgtaatctaaacggccctcagggtctaagcaggcccgacgaagactcgcccatccggtcgccagaaaactgggagtcccgcccgcctttccggcactgaaacgcgatcggccctgcctggtaccgcatcctcctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatggtgagttgtgactgtggtgtttgtgaatcgcgttccatcctcgtcctttgtgcctctctgtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgcgggtagtggtctctgacttggcattcgtggaaagaggcttctcccgcagtttcgatctttacgattgcctttaaattttatcagtaattggtttcccggagaactcgagtaaatctagaagttgccaggtttcagaactatttattcctttaatgtgcagacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgtaagtaacatttttcaggccaactgtgttagcttttgtttgtattgcacttaagtgggggcataggtttgaactttatttggtgcctatcttaaaactcgtacatctgtatgccgatgaggtggcataaaactcgtgtgttaacaacacctacaaggtgtgtgggagaacaccgtttgaaatcttttctgaacttatgttttagataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttcactatgttgcccaggcttgagtgtagtggcacgatcacggctcagtgcagcctcagtct

SEQ ID NO: 14417 - DNA, 2004 bp, Homo sapiens
tcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaaaatgacccttcttagaatgtgcaagttccatgagagtaatatattgatatgattttgaaaagaattgttgatagttacatcttcaaacttatcattccagtatgcatctttaagataatgtgattctaagtagatgactttatattcttgattgaagagtgctatacatgttaagaaatgcattaaggaatacaataaatattctaaagtgatgtagatcagtgtgactgtcctttatttcacttgggaatggcattgctaaatgtgggaataatgcaacagattgtcagggtagctaacaataaagtcagcacacatcaccacttcttttttttttccttttttttaaattatactttaagttctagggtacatgtgcacaatgtgcaagtttgttacatatgtatacatgtgccatgttggtgtgccaacatgctaatggtgtgccattaactcgtcatttacattaggtatatcttctaatgctatccctccccccttcccccaccccatgacaggccccggtgtgtgatgttccccttcctgtgtccaagggttctcattgttcagttcccacctatgagtgagaacgtgcggtgtttggttgtttgtccttgcaatag

SEQ ID NO: 14418 - DNA, 2240 bp, Homo sapiens
tgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacacccctacttgttgcttgttttatatttggctgttgcatcagaattaaaacttttatcatctcagtttactattttaacttctgaatgttatttcttctggtcctaataacttttaaagatggggtaatatagtggttaggattctgagctctggagccagaaggcctgagtttaatcatagccctgccatttataatactaactgtgtgactctctt

SEQ ID NO: 14419 - DNA, 1188 bp, Homo sapiens
gtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataacaaagaaatgcacttctgctattggtattttaaaaaataccttatattgttaataagaattagatgatttttatagaaacatgcttagaa

SEQ ID NO: 14420 - DNA, 1262 bp, Homo sapiens
aatggatagtcttgctttttgctattatacaaattaggtagcaagtcaaaccgccactgtttgagttgcaaatacaagacgtaacaagtaaaatactgttacgtggtgggtctctgtggcaggcttcctctcccccccatatggataattgtatactaaattcaccataaggtgaaaaatggatattgagttcccttcatgaaaagttatataaaatatatatttagcataaacttctccagagttgtcctttattaagtttctttacagaaactttaattggtgccatgattcttgtgggggaaagaatcataagagccatcaacttttttcctttcattttagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgtt

SEQ ID NO: 14421 - DNA, 1126 bp, Homo sapiens
agaaaataattaaaagtgtgtgaatctcctcaggagagaccatgtggttaaatatttacttatatcctgacatatcctcagaagattacagatgatatcacctacagctgattacatacattaaagggggtaaggttaaaaaaagacaaggtgggccaggtgcggtggctcacgcctgtaatcccagcactttgggaggccaaaacgggtggatcacgaggtgtggagttccagaccattctggccaacatggtgaaaacctgtctctactaaaaatacaaaaaatgagccaggcgtggtggcacgcacctgtagtcccagctactcaggaggctgaggcaggagaatcacttgaacccgggaggcagaggttgcagtgagcccagattgcgccactctactccagcctggcaacagagcaagactctgtctcaaaaaaaaaaaaaaaaaaaaaaaaaaaaaaaaaaaaaaaaagacaaggtggggcataaaagtgacatcagtgttatgttaagaagggatgaaatgtggactaaggtcaggtcttgaagaatccttgatttaagggaatggtgaagaagaatgattaaactaaaaacaggtagaagtgaagaagaaaactgtggcagcccaatgttaggggagaaaagtaggggaaaagagagtttggtgcaagggaatgtagacaatgctgttacacgttgatgaggtttagtaggatgaagactaaagtcattgggtataagaagacattggcgaccattgcgaaacaatgtcagtaaagagatagaggtgaaagctggattgcagtgaattgaagactgataggagagaaggttggtagtgagtgaatactacacttgagctgtttataggtaggaaatagggataaagtgaaagtgttttctatagaacgttatttttttctggcaggtaaaacttgatcatcttggtagtagaaggggataatgtggaaggggatggggttagtgttggaaaggaataaaaacatttcataagattgcttgagtgcctgcaaggcagcatccacagtgctggtcactgtcatatttgttttctcttttaatacacacaacaatcctgttactactcccattttacaaat

SEQ ID NO: 14422 - DNA, 1147 bp, Homo sapiens
ggcgcccgccaccacgcccggctcatttttcgtatttttagtagagacggggtttcaccgtgttagccaggatggtctcgatctcctgacctcgtgatctgcctgcctcagcctcccaaagtgctgggattacaggcgtgagccaccgcgcccggccaagtgggacatacttttgaaggatgtgcaacgttcaatgataagtgtgacaaaaactgacaaccaggaagcttgtgtactcagtgagagtagcatgtttgtctccaagaaacgtttcattttgaagacacgtggtaccactctcttactgaaagcgctggttcccctgttgaagcttgctaggcattacagtgggtttgactcaattcaaagcttcttttattcttgtgagaatttcatgaagccttccccctaagggtacctacactagaatttccaggaagaaatagagtttcttaatgcaattttcccaaatggagcagcatattgtatgggaagtatgaattctgactgttggtacttacgtactctggatttcccagaaaggtaatcagtcagccagatcaaaccctggaaaatttgatgagtgggcttgacccagcagttatggaccagttctacatgaaagatggcgttactgcaaaggatgtcatttgtgagagtggaattcacaacctgataccaggttctgtcattaatgccacaatgttcaatccttatgggtattcgatgaatggaatgaaatcagatggaacttattggactattcacatcactccagaaccagaatctttttatgttagctttgaaacaaacttaagccacctcctatgatgacctgatcaggaaagctatggaaggcttcaagccaggaaaatttgtgatcactttgttaatcagagttctaaatgtcgcgccgtgttttcttcacctcagaagattgaaggttttaagcgtcttgattgccagagtgctatgttcaatgattacaattttgtttttaccagttttgctaagaagcagcaataacagcagagttgattaagaaaaatgaagaaaaaaatgcaaaaagagaacacacgtaagaaggtggtggatgctttctagatgtcgatgctggggtcagtgctttccataaccaccacagtgt

SEQ ID NO: 14423 - DNA, 1376 bp, Homo sapiens
gctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaa

SEQ ID NO: 14424 - DNA, 1131 bp, Homo sapiens
tgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcggtgagccttggattccgccccagggcggaagggagagatggggattgtactgggttactctgccgcagatttacccctcgtcatttctttctctctgcttcgttcatgttttcctagtcctttcgttcctatctggggtggcctggttttgtaacagtcactgcgttaggaatctagagactaggtgtgtgtggctgcgctaacacctaccagctcttcaactctgaaagcctgagctctccaggattccagtcctggattctactttgtgagtgttcagccaaatggaagagcagtggtgatgaagagaaacgccacttaagagagtggggcgggccaggtttcctgttggctgttccaccacaaagctgtgtgaccatgtgtcacatggctgagtagtaacttctttttaccttaattttaaatttagtatgtcttttctttttctttagtaacttttttgcttaatttttcgcgttttacggtagtagttctttgtt

SEQ ID NO: 14425 - DNA, 1123 bp, Homo sapiens
ataaagttactacttggccttggtaattgggtaatgacatagtaccagatgtagaaagcatctgtgtagataaagcttgctgctcttagatgaagtaaataagactgatgttgttgaaaaagattaatcatgagattgaggatactagaagggaggaaaatattatttgtgcagaaataaaatatagggttagaatagagatgataaggaaactttgaggtcttcagggattttgttacataaagtatctaagttgtaggaggtatttgataccctctaatgtctaatgtgattgttttgtttgggtaagatatattctatgtgtaaatttcagcataactttcttctacaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctgggtgcaatggctcatgcctgtaatcgcaacactttgggaggccaaggtgggtggatcgcttgagtccagcagtttgagaccagcctgggcaacatggcaaaaccccatctctagtaaaaatacaaaaattagcctgtcc

SEQ ID NO: 14426 - DNA, 1171 bp, Homo sapiens
aatcttattttctttcttacgctgttctctttctgttaattttcctttgttccttgttcccaccttctctaactctttgctggcttttcataaattagtatcaactaaagatttcctatcctggaaattttatctgctcactcaaatgctacctgaggttaaaactttgaagaaaataattactctaaggtaacttagtaggtgggaagaaagaacaggggtttgaaaacatgaagcctctttcttacccaaaacatttaacttatccaaaaaggaacaatacttttgttgttaggctcaataatagaagaccttccatttctatacattggagacaattatatcgaatctatctactattattattactactaactacaccctaactactataaattagtttcattgatatataactgaaagtacttaaaataatgtaatgaaaaaatgaaaggagacaatatttgcacatttaatacatttcctttacctaaactctttcagtaacatacatttctctattttattctcagtccctgaacttcatgggaaaaacaagccattgatctcttacgtaggggattctactgtcttgacatgtaaatgtcaaaattgttttcctttaaattggacctggtacagtagtaatgggagtgtaaaggtaagatagttccttgatttgaagaaaacaacaacaacagaaaacatttatttaaaaaataacaagattgtaacagactcagcattcctaagatgatttatacttttgttatcttgttgtttagcttatgttcataaagaaagagcagtgacaaacagagttgtcatttgatggtttttggcatgtttacgttatacatatgaagatactcttaacgtttcattagctggtagtttgttttttaggtttaacaatttaattacattctttgaaaagaaattacattttgtgtgtagttgcctagtttagaaataaccccattagaaaatattctttttaaaaatcattccatgaaagtaactagaaaaaatgctagacatctttttgggcttctgtctcctgaaacatctgtgatagaatgcaaaatagtggcactatttgagaaaataatgaaaactttgtaacttaatcttacatcttaggttctatcagaaagtgtcattggccttt

SEQ ID NO: 14427 - DNA, 1235 bp, Homo sapiens
tgggcaaatatggcatgaattttgaaagccacatttccccaaggcctactcccttttcttgattcgagagtaaggctcgagtatcacctccttccctcctcttggcaggtgggttggctttgaggattttttttttttttttttttttttttttgagacggagttttactcttgttgcccaggctggagtgcaatggcgtgatctcggctcaccgcaacctcctcctcccgggttcaagcgattctcctctgtcagcctccagagtagctgggattacaggcatgcgccaccacgccgggctaattttatatttttagtagagactgggcttctccacattggtcagtctggtctcgaactcccaacctgaggtgatccgcccgcttcggcctcccaaagtgctgggattacaggcgtgagccacctcaccttgccgaggatgtttttttagagctgagtaggggaaaaaacatcataaccaactagccaaccaaagatccacaacttacaggataacgtgtgtgtatcttcattttacaccgtggtctttgaaaacaaaatgtgtgtgtgcatgtgtgtgtgtgtatgtgtgagatttttgcttgttgttttattgtttaagacactttgacagagggattacgtgcaaaacattaacaaagccaacacgaaagttgccattctaccttcacctgtttataattacttttcatattgaaaggattccatccaacctattgcaagtttctgtgtcataaatgttaccagccagtaagggtaataaaagaccacctctcaagctggtaaatattggccaccagtaactaaaattgggacattattctgcaaaaagttttcaaactctcatgggaatttattttcatgggcttgtaagatgtggaatttttgtaacacaccatagagaaggaaggataatcaaaaggtaagactattaatttttataaatgccttttaaaacgtctagttgttaacaacttggacagaacatcgtgggttccttcgcagatttccttgtgccacatctcttttccataataccacttataaagaattgtccaggcctgtaatcccagcacttttgggcgctgaggtgggaggatggctggaatccaggagttcaagaccaccccgggcaacatagcaaggtcccttctttattaaaaaaaaaaaaaaaaaaattaaaagtgcggttgtggtgatgtacaccagtagt

SEQ ID NO: 14428 - DNA, 1570 bp, Homo sapiens
cctttccacaaactatgtaacttctagtctggttctagtctcggcctgtgctttgagatcatctgtgatatagggaagggtggcaggtaggtagagtgcatatgtcaaagaacagctcataccagagggcagctcaaacttgtttaggaacttctgagaggtgaccacttaattcaacagctaatgaagatatctgcctttggaaaagcatatttagaaatgttgaagtagtaggtatgtttggaaagaaaaaaaaatgtttaaaactaaagactttctgtcttcccctatgtaaccttgcccatgatgtctctcgtcatgattgttaaaagaggagccattgaaatagatgtgatattcatttgtctgatttattcaaatatattttatattcgtatagtagaatggtctatttttaatacctgttatgattttgttttttaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgtcataaagctaactagcaacaaggtggtttgtgttgaaatgtttaggtaaacaatgccccaatttttaactggttaagctttatagtattttgatagacttgtacatataagtcccatatagttcttaaatttttttttccagctttatttaggtatacttgacaaaaattgtatgtatttaaagtatacaatgtgatttttgatacacatatacattgtgaggtgattaccataatccaactaattaacatattcctcagctcacatagtcccctcttctgtgtggtgagaatatttaaggtctactctcagcaaatttcaggtaaacacatagctcataaaataataaaatacaggcaaaatttgggcag

SEQ ID NO: 14429 - DNA, 1220 bp, Homo sapiens
taaatagttgaaagtttatcaaaacagttaatcatttaaaatgaattttttctactctccttgatgtaattttaaaacctgttatatttaactatgatgatcattaaaacaagtcagttattatttttcaaatgtaattatttctaaattctttagataaataaaattctgcagaactttgttgtttaaaatatatgcttattgaaatgctatttttatgtagtatcaagctgtgtaaaacttacatgtactaaatatcacaaagaaaatgaatgttaagtattacagtttttatatacagacaggaaccattaaaacttagagaatgatcgttctatatttaaattgtttaaggaacaaaagatctttcccctacagtattcagccatctctattatctgtgattcttcagcaattaaagcagatttatttccctctttgttcctacttggaatacttgaacaatactggagaattgaactgactgaaatgttttatctttcaaaaggtttaaagttctatgtaccaattagcaaaatacagtaaaggtttaaactgttaatagccacaacatctttaatgcatagacctgtagtatgctagtgctgtataacagttctccattgtgtgtctcttttaagcagagtaactgtgtcagttcttttcttgctttactacctgctgtgtatggaaattgtgtatcgtacttgacacttgctttcaagaatttaaaattcttgcatgttattatgtaggaaactttggctctcaagaaaatagaattgataatatttcatttgtttggattttaagtttaggttttttgtcatattctagagagtactcatttatatctgaaaatacattattagtctattactcattagtgaatttgaagtacataaactgtatgttatctccttgaaaattgcttatctaatttttttcatttaactgaatataattataaagaaaccatcaaatttatggtagggtatgcagatagatccctgatgctttattttacactctatttgaatttggttttgggttttttgttttgttttgttttggtctttttggtagtaaatagtactttgtttttaaagttatagctcttgaattagccagcttgccagataagtttataactcaagaattaatccaaatacttaaacttgttaaagccttatatctgccattttgtagtaagttctcaa

SEQ ID NO: 14430 - DNA, 1222 bp, Homo sapiens
actatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggccttgctttccctgcaagttcattaaatgtagaatgttgtctttttaagacaccgtggctgagtgctcctaagccatctgttaaatgacttcccgtggtctgcgtgtgtgtgttcatgtgtgcgccagtgatgggcctctcctcaaacccacgactgtctgcagcgtctcagccgtcagaatgaaaacattatcaatcagtacccaacaacagctgtttttgacaagtttctgtctgacgcctaatgctttacaactgtcaataaggctccctctttgtctagcaggtcggagctcgctgtcttgctgcttccgcgcggcatcctgtccttgtaaccctagaatttgccatgttttggaaatccacgtgggggcggggtggggcctgaacgggtggggatgggtgggtgggtggtggggtgggtgggatggctgggggtgggagtgtaagtcccttttcctactttcatgtaaagtgccacaggtgtcttggtttgcatattcaaatattatataggaaaaacagtctgttatgtatttcttcacctagcttcttgtaatatttatggacgtttccagtttttgtaccttcttagctaaagcagttgcctttttgtaatggcaattaatttatatgataaaactttgtatccactgtagttgacagtattggttgctaattaactgccatattgccctgtctttctattaaaaaaatactgtacctgtacttagaggctaacagattcatgtggacatttaccaggcaagaccaacttgtattgtccatgatttctacgatttccactatcttcaaatgaaaaataaacgctgagtagaactggtgttttcagactaactcctttcaacttt

SEQ ID NO: 14431 - DNA, 1150 bp, Homo sapiens
tgtctttcctaggtaaagagcaaatatctttttccttctttttgtgattcatctttcagtaagactgatagttataaatgtagcgttgtcatagatatggtctgaaaatgattctaaacttgtgtatactggagcatatgtggctttgagtttcctttttatttgtatccattttaaatttacttttctcaaaacttttgcttgtaatggaatttgcataataccaatatggggactgctttaagtaaagcatttttccccataattaaataaacatataccatacaggtgcatgtctacactttagactgctttaatgggatacatgggctaattccattataagtcttgaagtttatggaagcacagtgacatggttatacttactttgggtctggcctaaaaagaaaaggatatatcctagatttttcccatttcttgatgacagagaagtttctctgtgtactgtattaaaatgccttgttgaaatgctctcaggaatgttttaagaattaaatcagtaccttattgttggcataaaaatggagttgtggaattgaatcttaaacattttgtaaacaataactttaaaatcgttgggagcaggcattggtattatagaagaggcagtagaagattgaaaagtgagcaaagtcatgtgttactagaaatgtatttagataacggtcgtctttttattctctctttcctaaaggtgttgcacatcctgtgccctattgctgataagcattcttactcatttgcacctgctaatttgtgtatgttttatggaatttaccaatgctaaaaagatggtattttaatctgcaaaatacttgtgaattttaggcaaaattctgatctgtcagaatcaaggaaggtgcattcaacttaccaaaaagcactaaactttgattcagttagaaaagataatcagtcataaaggctattgattcttcttctcactccattgaaattattacattttatgtttaatgcagaaaatgtgcaataatttatcctgtcactggagtgaaactgtacaaacacactattggttgatgagtgtgtctggatactgttgactttagaagtggggagaagccagtgaaattcaaaagagaaagtcaaattatcagtgggactccaa

SEQ ID NO: 14432 - DNA, 1197 bp, Homo sapiens
tttgtgtatttttatggcctacttcctgtttagaaatgttctgttcaggtaatcagcaaaaaaagagatttgctgtaaaatgcattagtttctcattcactttcctttaaattgtattactttgctctttaggaaaaaaatagtacatggtctgaaactgacctagatgaggccctgatttggagatgtttatgaatatggcatataaaggttaggtctcgttacagacatttatgcctgggtattttattgctggttttattgcataattctgtttttataaaaattgattttttcccttcaagccattacaatgtaagaattagatttttttaaaagaaacatttatttttttacttagttttctttcctagtaaaagaaaaaaatcctattcctctgatctatttccaatgtgagaagatgtgaaattatgcatagctgggaattatatgagaatcttgaattcatttctttaaatctaatcatcagatacatgccctaacttttaaaatctcacttttggttcatcttgaattccacataccgagactcttgaaagccactgatcggggatgactgatgcagactgggagccacgtgggccccgggtctggttcagcgcagcagcactctcttccattcaaagtctcagatgtctgcccctctgcaaagccgtgaggccaatgtctatagctgctaagcatgaaatcccctgcttctgtttgtttcttttgttgccacgagttaatagggacagagacaggagacagcccagaacaaagcagaaataatggagtatttcaccccaaaaaggaatgtggattgagaaatacaaagggtaaggcaaagacagatttagtgtcctgaggcagtgtgatgtattggccagaagcctcagccctgggacaattccagtccaaagccttcatctgtgtgctcccagcagcccacatggctgaaaggtttgacccaccttctataaaaacaatttgttgtttttttcccactagggtcttaaaggatgacaggatttccacctcaaaacataggttgctcttggaacgtggagaagtcttcagctgggctgtgtctggcagccaggggcctcttcacagcactcctttgccctgtttgttatttttcttgctatagatgccattttgaacttgtttgcaagaaccactagtcaccctaag

SEQ ID NO: 14433 - DNA, 1350 bp, Homo sapiens
gattccttctttttttaaaatgagtaattatggtcctcactttaaatttcaaaggtattgaaaatagtttgggcaactatttataatgcccaagattctgtttaatatgtagttatgttcttgggatatgtggatatataggtttttaattaattgttatttttaactacaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggtttt

SEQ ID NO: 14434 - DNA, 1909 bp, Homo sapiens
ttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaa

SEQ ID NO: 14435 - DNA, 1100 bp, Homo sapiens
gacccctcacttttccaaacatttacaccaggtgttcctttatttgtcactggagacaaccttgtaaccccagttctctctcaggaaaagcctatgatttcctcaagacttgtggcacagacagaaactttagggaaactgacccagaccagatggcagaaagcagatccctggggacagcacagtggtgaagagcccagtgtggatggcagagtttctgccatcaaggtcatttggccaccagccaccactaatagtcagcttttgggcacccacacagcccagagagagcagttaccctctgatggtcatcatacccttggctgccgtggtcttcgtgctgaaagtggctgcagtggccatgtgtgtctggttgttgagccagaaggtagaaaaggcaaaaccccttatcaagccccagaccaatccggaacacacaaccccaagtcataggccacaaaggagcataaagttcccactgtcacagtgacaccccttctgcaaagctccagcagccccccagtctgtcttttcagggccctgcagtgtgaacaaatgtcttctccagtggccgagccagtggacaaatgtgctgcttgggagacatggatgaacctggtcaaactctgccgacaaaccaacccaacactgaagcacaaccagtaccgggtgtagattgagggctcgcatttcttactgaccacctaccatgtgtcaggcactgggataggcattgggatataaagcaaataaatgctggttggatcaactgagaaaagtcaggccctgctagtgattcaatgttcaatcctagctccatggttagatgttgcggggtggttgattgtgacttgtacaacactcatgggctttctgcaatgggctctgtgtgtcatcttctggacctgactttctcagtatacatcagttggtcaatatttaaaccctttactaaggtagtacagaacatgttagccccactgagaatgctagtattaacctggggcatagagttaaaggaggaaagctttgaatattttacactgagaattccctctgagtgagtcagcaggaagtacaagaactatttcagcatgtag

SEQ ID NO: 14436 - DNA, 1173 bp, Homo sapiens
aaaatacatataagcatataattactggagagaaaagcagttgagagagaaagagaacaaaacagctacatgtattgattgctgttatttcattagaataaaatgatgtgccatttgtataggttgggatctccttcggttttactagcatggcttaaatattccaactttaaaatttcctgagtttagtatgtaatctataagcatgggaagagttttcatgtgcaaatttctctcttctttttcttttgtgaaaggtccgattttctcaataaaacattatgaaatgaaaagtgagatgagattgattaattatgattctttttcaggtgagagtaaatttgggtacaagtgaacaaatgctcctttctgagcagagacttcatatggatgacctggtttggcatttggtggaactgtgctatgttaagcataatatttcctttgttattgacaaacgttatgagacaactggccaaatggcagctggtgggatgcataatttgaattttcaacatggaatctatgtaggaggccgcagggcactcaatgtaccttatctgtacggaaagctccccaatttttgaggatgtatgaaggatgtggtatttaaccagagggagatccttacgtcccttagatcttaccctggttttaagaaggtttatgaggtgtcactaggatgcaatgacgagttttttttgcaggggaggatgaagccatcaatttctttagctccagattctctgtcagttttccagaatggaaagtgcaagggtaaacactattggaatttactttgcaaactgtaactcagcaagccttgctttcatttcagttgggtaaggaaggagattttgttgctttgtaaatagatgaaagtctattgaaggcttatgtaggaaggcataaaagtaaaactcagctttcttcttttagttttgtcagtgacaacaagtggcatgttattcaattcaaattcacaggggagtatctggacctaacagtagatgaaaaaaaggtaaggaagtcactgcctttgcaaagcaaacatttgtatctgaaggagccctttttgtgggaggtcttgataaccaaatgtgggaagaagtaaagaggttagaacttgcctctgtgcctgggaaatttgctcgaggaacctctttcaaaggg

SEQ ID NO: 14437 - DNA, 1133 bp, Homo sapiens
ggtggctcatgcctgtaatcccagcactttgggaggctgaggcgggcagatcacaaggtcgggagatcaagattttgctgttttccagaatatccagctcaaaggtattttttactgccagtgaattagccaatatttcccagaagctgtcatatatttgtaagcataattaacagtaattggcttatgtggaaagccaaaatttttaaaagcctaaattttaggctttaaatttagattaaaagcataaattttcgatccaaaatgataataagtctaaaatttagttttgttatgtcagtgtgatgtcggtttgaaacattattctcacatgttttgcatttttgtgctttgactttaactcttctcaaacttcatgttgtttttaatcatgtttcctttcttagggtttataacttgttataaattttataaaaagagaaattttaagaatatgttttttaccagtttttttcctaaactctgaattttaactatgttcattcagatttcttctggtgaatacattcagatgtctggtcgtgctggaaggagaggaatggatgatagaggaattgtaattcttatggtagatgaaaagatgagcccaacaattggaaaacaattacttaaggtaactacattaagattgtgtacctttaccaagaattccagaaatatacttcaggagccatttcagaattggttgtgtcagtcagacacctaagtgaaatgagttaatatactgaaactatctgggcttgggaagatggaagggtgtgattactcaaaatactaacatcttgtatcctacttcacctaataggtggagagcaactcatgtaatggatagggtgtgaagatctccagagagggcagaaatgtttactttgtcctccaaatttaagaaatctctttatttgacccatccactgcacaagttgttctttacctggtagaacaggaagttctgttctactgataatcaagtgttttgggcaggcaatgagcttcctctacctttgcaagcgcagatagcttaataggttaattcagcaatctgcgtttacactttaccctattgattataaatatcccaatcaaaaaggacacattttaagctttattgcaga

SEQ ID NO: 14438 - DNA, 1184 bp, Homo sapiens
gcaacctctacctcccgggttaaagcaattctcctgcctcagcctcctgagtagctgggactacaggcatgcgcccgccaccatgcccagctgattttttgtatgtgtgtttttagtacagacggagtttcaccatgttggccaggaacctcgtgatccacccacctcagcctcccaaagtgctgggattacaggtgtgagccattgcgcccggcctctgttctctgtctcaagctttttacactttctaacatctgcttgctctgcctcaaatttttcaaatggacattttgtattttccatgtacttaatattttaggtagtatttaataactttacagatacatcattactcttgtgtaatgttccgggaatgtatctaagaagctccagtttccccagtctccccagcactgaagctttaacccagaagtatactgtaagatgttctttaaaaatattttttgtttgatttcatgaataaatctccttgtacattgttcactttattattgaactttctttatactttcatgtgctttagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcaggtaaaatctggttattgttctagaaagttcattttttttttcatttttaattttaatttttgtttattttttttgagatggagtctcactgttgcccaggctggagtgcactggcgcaatctcagctcactgcaactccgcctcgcagttttaagtgattttaaaaataaccattatctttaggaaaaaagagctttcttaaaaatataaagtttgtacaatatcttccacactaaatacagttttgaaccatgaaattgagaaattagaaaaatcttagatctcagtaattaacacaagcgctcctagcatttgtatgtatttcctttgactttttttaatgccttgtgggatttttacataatcttagcttatatataattttgtatactttttaaaaattattaacattttcccaccttgaaacttagcctagtaaccattatcttgttacgtgcatagcaaattgtaatgag

SEQ ID NO: 14439 - DNA, 1249 bp, Homo sapiens
tgggaaaaggcttctttccttgtgctccttgagaacactgtgtaaagaacgtactaatgaaagaatctaaggtcaagaagaatgaatgcacctttaaaatgacaagttttatcttgttactctcctgctaaaaacagtctgttgcattctatgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatctttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcgtgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatttatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaagg

SEQ ID NO: 14440 - DNA, 1169 bp, Homo sapiens
ctctactaaaaatacaaaatttagctgggtgcggtggtgggtgcctgtaatcctggctacacaggaggctgaagcaggagaatcacttgaacctgggaggcggaggttgcagtgagccgagatcacgccgctgcactctagcctgggcgacagagcaagactccgtctcaaaaaaaaaaaaaaaaatctgatctgatgaaacaattttgacttttgagaaaaaaatcagtagaataaaggaaatggaagtggttagagatatttaggagggagaagaagatgcggagatgtgtcattgattttagacaattcttttgggaaggtgggccctgaatgaaagacacaaaatcatagggacagtgtagaaacatataaaatgatcttggttgatggagatttaaaggggatgataagagaatactgtgggagataggcttaaaaaggttgaatcactctgatttagataattattagctttgaacttcataagtattgttttacttctccaaacatttttatttctttgataatttatcatatcccagaatctaagtaaataatgcattataaatagtctcagtttaaggattaggccacacttggcttaggtgtaaacttcatgaaaggttaagaattggcataaatggctcaaaggttagggtaaggaattaaaatgaaacaaaagaatatggttatcttgtgtggatcaaatgggcagacacatctctgcatttaattcagaagaattgatttagaacttctttattgtctgcttctctcagcgatgtgagttgacctagcatttgctggctttagagactcccctgcattcccattattaatggttaagtttcagcttacactacttctgaagatcagcttttaatctgtgcccagtattctgaatattcctagcaaactcattttctgtcatcactggcaagagccaggatttgggtggccataaactatgatgattatgactgggaagactcacaaaacatactacctgtttctggaaaatagttcagtgcctaagaacagctcatacctgagatgtggaagtttcaactgctgaaactgtggttgattaatatacttgatatgttttcaagaatcaaagattaattccaaaatgaaatgttagataagttctttctggctgctga

SEQ ID NO: 14441 - DNA, 1495 bp, Homo sapiens
attttggaaaaggcgcgatgttttagcccagtgtattaaaccatatcctgaatacaacttattagtgtttaattgctaagggtcatttcagattttagccactatggcattaggctgccgattaatggacactgagtccattaatttattcaatgcatattgatggaaggctagcttcgtggccagtaccatgttaggtactagggatacaaagatgaataagataatccctgccctgaagggctcagagtctaatgatgaagaaataaacaagtggttataatacatcatgataagtacgataatggaggtttggaatatgttccctttgagcaaagacgagagccttgtcttagatctgctccattgtagataaatgatttgtctgtttactcttagagacgcagaaaggtcagaagttacctggaattactcgtagctgctgctgcttttttttttcttttccaacttgatatagggcagtaggaacccaagtaagtaccaatgtttatgacttatttgcgggcagtcccacaatatctagaagatttagctggaactgacaaaactttgattccttatacctgtgttttgctgtttttgacaatcatttagaatatctttctgtgctgtgtgtgttccatttgcccttccagatcttttctccactctgctctgtgcttctgggaaatgaattacatggggtacatcaactgagcccttcctttttggtttcagattagctttgcccagtgggagggacatcagaaaggatctccctaaaagctagttccctcttgctggatttagtgttgccaaagctgttctgtgagtagttcacaacttgtattcaataatggccctctctgccagccatctatagttacacatctttctgggttctaataacccttccctagcccctttagacctggagatgataatggcttcctgacgttgctaacctggagttataccaccatcttttgctgttttccctaaaccctgcctgtaccttttgaaatggttccttcattaagttttcttgaatacttcatttgagtatgctgcttttcttggcaggaccctactgataatacccatctatgtctaaaacagatttgaggtagcttccgtttctgcattaaacaccaattacagtgtccttaatggcaaatgcaaacaggagcccatgggctgccatcttggctttcttgggagggagggggttatggttccctcagcatgctccaaatgtggtatcatcattatgccaaatcaaagtcaatgggtatagagtaaaatctggctgcaaaaacatttgcaaccaatgctagatggttgtggggtccctgttgcttgttttaacccagtaattatctcaaatactgatgccatttcttattaccataatgctgacatcattttaccccttaaggatactcctaaggagcggtccctttgttaagcctcaatctgggtcccttcctcaaag

SEQ ID NO: 14442 - DNA, 1166 bp, Homo sapiens
agaggagcctggtcactggcccatctcagtagtgaaactggaggtttgatgcacaggggattctcagtagcaggcgccagtgcctgatttatcgtgagaagcagtttaatatttcggctataaaaggctagaactagttcctaattagaaggtgtgccaggttgtaaattgtcaggttgcaagtagggatgagcacgccaagtttttgcgtataggtctaaagaagttttgggggtgggggaggatgcggtaccccagacctgtttccttgtctgcccagaccttgccatggtgtagctttccatctcttgtgacagtgtctcaaggagcagtagacattctttggctgcagcagatttcgcattgtcttcctgattggaagagttcagttatgaggcttctggttgccagttactcctttcttttgaagagaaagaactggaatcatttggataagggatgggcgttggaaggagtagttttcactttttatgtattgtataaggcagttatgctgtgaactatttatatatgatggaataaacaaaaacaaagcaagagctgctggaggtttggatagtcctactcatgttgaagtaatcagaatagtagtagtattggcaagttctcagggtgggagatctgtggctttagccacctggatggaagtctgcgtaatggtttctcagtgacaggagattccctcggttttaatccagtagttcctagttattccactctccagtttccaaccgggtcatttaggcccttgcaatcttgtggaattcttataaattctgttaccaggttttgttgttgttgtaaggaaaaattccattttgttatcttttttttttttttttggatacagtctctctctgtcacccaggctggagtgcagtggcgggatctcggctcactgcagcctctgccgcctgggtccaagtgattatcctgtcttggcctctctagtagctgggattacaggcaccgccaccatgcctggctaatttttctgtttttagtagagacagggtttctccatgttggccaggctggtctcgaactcctgacctcaggtgatccgcctgtctcagcctcccaaagtgttgggattacaggtgtgagccacagcgctgggccctaaaactgcattttgttacctg

SEQ ID NO: 14443 - DNA, 1221 bp, Homo sapiens
gggcaacaagagtgaaactccatctcaaaaaaaagaaaaaaagactcgataatttagaacttctaaaatcttgtattagacttacgctgtatgactttgccttcttaagtttttttttcatgagatcaactctttggcctattatttggcttggtcagagaactctttgtaagtgtgtatatcctggcccacacattagaatgatgagatatgaagtcattcatatctcaactaattttagaccttctttgtctgctgtcatctctttgaattttctaattgaatttctttcactttttgctctcatgcttaactcttgaatttagcttaacatacaactgaggatattattaagtaaaatatggattatttagaggggtcttccttagaaagtctatatatgaatatgtggtatgctaatagccagaaaggacaaagaaaattaagtttgacacctgtgggtgatcatccaaaatcaattttattatcacacccaaaaaatgctttgatgtaaggaataaatttattcataaaaggggactatattaaagggaaatactttatttatattaagtatattttgcaaatgcaatgcagctactaactatagaagtaaaagacttttctgtccagtgctttggaggagataaagatgtataagacatcattcatatctgaaatgaacttttaatctagtaaaggaactgtgtatataattaactatgatgcaaagcaatttatactgaggactattagagaaacagatccctttcagttgggagccttgaggagggttgataaaagaagccgagaggtcaagcagcaacgacccattttcaggttcctcctcataactgtccaaaatttaatatttggtaccttcaccagcaaatgcaatcatataggttaaatgtattcgcttttagtttggtaaatttcctctaagataagttttctgcgacttgtttaatgcttctgtatgctatttattctctttgcattttgaacacattgcattattctgttaatcttggacagcaaagcacaatggattaatagggcaaataattagtaacacattgggtggtacaaacagaaaaatgcataagtttttctcaccaaagatttgacttatttaaatatcagtattcaaagtgtcaaatgtttgaactcattgataagagcagaaaatattgatgttgtatgttttctttacaaagc

SEQ ID NO: 14444 - DNA, 1069 bp, Homo sapiens
cacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaac

SEQ ID NO: 14445 - DNA, 1412 bp, Homo sapiens
tttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatat

SEQ ID NO: 14446 - DNA, 1164 bp, Homo sapiens
ttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagcta

SEQ ID NO: 14447 - DNA, 1154 bp, Homo sapiens
cacccagactttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatgaaagttgattttacatagaaaattaatgtgaaacaaaccagttgatgacagttaggatggatgtatatatattacttcctgaaaagaagtgtaagagttgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatggtggaagggaaacacacttggagacaaacttcactttaaaatctgaatggtacgttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcct

SEQ ID NO: 14448 - DNA, 1236 bp, Homo sapiens
cctgcctcagtctcccaaagtcacataccctttctttaaaaaaaaaaaaaatgctatttgaggcactgcactgaatgtattctgaagctctgttcagtgaatgccatgattgttaagtaatgtctgccactggtagaagataaaatgatgtcacatatgtcacatacttgccatctgtcatccaatcctgttttctcatgacagttttaaaaatattaaataaaatagcaaaatttcctgtcttagcctctcatccaggctaaagcacctagtagaaatactgaagtctgtaaattctggttgatatcaaaagatgacccctcaaggcatccttgaagtggccttaaaattagagcaagaaagagcattttattttttcatttattaccttttattagatacctctggctcttcccttttgcggctatcaccgaagcaggagtggccaaaatgaagtttaatccctttgtgacttccgaccgaagcaagaatcgcaaaaggcatttcaatgcaccttcccacattcgaaggaagactatgtcttcccctctttccaaagagctgagacagaagtacaacgtgtgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagactgtgaaaagatccttgaacggaaagccaaatcttgccaagtaggaaaggaaaagggcaaatacaaggaagaaacaattgagaagatgcaggaataaagtaatcttatatacaagcttcgattaaaacttgaaacaaagaaaaaaaaatacctgtgaatacccaagagtgccataattatttggaatctctctaaaaacactgatttttcacaacttaataatgaaattagtattctcctaccacccattgcacacacattgctgttggtgtgtagtgtgttgctgtggagagaacattagatggggagttagggagtgttatggcccgaattatgtctcaccaaatttcatatgttgaggccctaacccctagtcagactctatttagagacagggtctttaaggaggtaattaagcttgaatgaggtgataaggatggcactg

SEQ ID NO: 14449 - DNA, 2345 bp, Homo sapiens
ccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaatg

SEQ ID NO: 14450 - DNA, 2827 bp, Homo sapiens
cttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataag

SEQ ID NO: 14451 - DNA, 1706 bp, Homo sapiens
ttaatggtttctgattatattctggtaagtccctgaaggtatttattacagttgtcacttgaggcaataaaaatgtgggaaagtttagtaccttaatcagtgtgacaattattactcacatctactttgtctggatccagaattttttcagaaatatcattacttgtgtagtttttgggttaggatacaattttattatattcatgcttatattattacagtaggtttgtaactcttgagggataatttatttattttgctgttaacattttagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaa

SEQ ID NO: 14452 - DNA, 1207 bp, Homo sapiens
agacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaa

SEQ ID NO: 14453 - DNA, 1450 bp, Homo sapiens
ttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatcttt

SEQ ID NO: 14454 - DNA, 1261 bp, Homo sapiens
gtgtttctcatgctgctcacattttatttgccaaagtaaggttaccatgcctaacttcaaaggggcaagaaagtgcaatcttgccatgtgccttaaagagggagaactgagaatggtgacgaatagcaccaatgatgagtacaccttcttccttgaagttttgcatctatatccttctacttcccatccaatcctgccttttatgacatatctctctacatatgatcttcaatcatgtaaattgctcagtatttctctatattaattagtggttctggctaagggtctctcacgagttgttggcttgggctacagtcatctcaaggctcagctgcttcctcagtgactcatatagttgttggaaagcctcaactccttgccatgtgggcctctctatagggctaaccacagtattatagcttgtatcccccagagtgagagatgagagagacagataggcagacagagacggagacaaaagacagagacatcccaagacagaagtcaaacacagtctttcataatctcttcttgaaagtgacatgtcatcactgctgtctgataaccaatcctgggatagagtgggagggggactctacaaagatgtatgttaaatgccaggaggtgggagacttcatggaagctggctgccactctcattcaagaaggctacttactcttatgtaaatcttggctgccaaaaattgctgtctaaatcatagcttcttccaagtagcatacccaggacagggtaaatgcaatttaaaacttctctcaagggggttacttcatttagactagtgttggtgttctcctatgcaattaaatggttcttgtgtcttatcattttcaatgtccaatatccaaggaaatacatgcactcatccacagaatattttctttatttttaaagttttaatgctgtttttaagtcccttgtgtttaggtggttgttatacttgaaatgttagcagacataatacacagcaaataaattcttgatggttttgcttatcctcttctctagaagcatgcgctgtgtgagctaagtgtgactttaaataggacatagggaggaattagaaatagaggcaaagtggcagaaaccccacattaaaatccatccttgtcagcactctctgatttcacataccagggttcttttcggattaatcaaaaaattgttgaaacgtgttaaaggagaaatgcaattctgtaaggggaacacagttcctatttggagggaaggaatatgtatggc

SEQ ID NO: 14455 - DNA, 1236 bp, Homo sapiens
ataacacctattattgacccttttgtagagatagcgttgcgtgtgtttgtgttgcgcggacgcagaaatctgggaagggcgctgcacagcgttttccagcgctggggagacgcccccggccccttagtcgcacctgcctaggtgtgctcgcacggtgggaccagggtgggcaacagatttcgccccgggcaagttcgcacgcggagctcccagcgccgcgggtctcggagaagacgcctgcctccccgcgcatttccggtgacgtgctgccgcgccgcccaatcagcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctggtgagtgagtgtgctggggcctgggcggagcacccggtgccgcgagcccccactcagcgcgcggacagagtgcttgtcagtcttcgcttccgcaggccagcggggctcgggtgtggagcatttcagctgggactactggggctgccttttagtggacgagcctcaaagaaaggctaacggggcccagagctcagccggccgggggttagtgcagctttgtccatgagatgttgactgggttctcggcagtagatggcgcctctctgtttaaagaccccaagaccaggctgttccctgccttttgtcctctggaatctaaccgacccggtcggtaacctgaggggccaccacgtaccccgtaacgctcagcgttcgcggcagtccaggcagggcgtgtctccttcctgagtgacacctgatgatacctgacggggtattcgaataaacggtgcccagaacagaggggcatcgcgctggccgcatttccggcccctggcgtttctgtttctgtcagcaccgatccagatgaagagctggccaggacagatgttttaggagagtctttgccgactctgagttcctgtttttttttttttttttttctgggagaaaagctttggtattgaggtgtacttggtctgctttgacttggaacaataaagggtgacagtttggtaatgtctgtggcaagtttttagaggactttctgtggaagtgtaatggtaatttgggaggacagtaacttgctccttggtctgccgacctctctggccacatttaacatgggaattactctcatagttccat

SEQ ID NO: 14456 - DNA, 1220 bp, Homo sapiens
tgagatggagtctcactctgtagcccaagctggagtgcagtggctcgatctcggttcactgcagcctctgcctcccgggctcaagtgattctcgtgctttagcctcctgagtagagtagctgggactacaggtgtgtgccaccatgcctggctaattttttgtattttagtagagatggggtttcaccatgttgcccaggttgatcttgaactcctgagctcaggcgatccacccacctcggcctcccaaagtgctgggattacaggcgtgagccactgcggctggcctacctttaatttttgtaggctgtggtaaataattataaatttttacagtagtttagaatttgccttttgtaatatacctaattcaaaatggaaatctattctcgttttcctgttaatttaattcttttactatataaggggttatgcaatattcaaagattaattgtagaactactgtatcataggttcatttaaaaatgtattaatgacttttgtcttataggacaaactattcgagagaaaagaattgtagaagcagcaaataaaaaagaagtagactatgaagcaggggatattccaacagaatgggaaggtaagtttctgcttttagtagaatctcatgggaggtaagttatataacagtatacaaattcaataagagcatatatagttatatactgtttctctttgcaaaaaagttttagtgtctgaatgtttgaaactttgtttttttaacattgcatttctttgaaagttgtgaaggtgctgaattttagtaagcagatgcatgtatagcaaaaagaactattaagcattatcagagctgagactaaggtgaggcaagccaaaatcctaagatgcaaaatttaagcaggcactcactttcatgtagtgacccagcacttgcacaatcctaggatttgaatcctgtttctggcactcattacacacatgaacttgcaaagtaacttaaacttttagttttttcttttataaattatgcataatacttgctgtagataccatttggagtattttttcaactcacaataactctatgataactgactgcctgttaagacaaggatggatgctcgatccctttcctaagactttgaagttaaaataaaagatcaaagggagacaaacagcagcagttggtctctcagtgtggctctaacagtaacatatgaacttagtagcttgtaagt

SEQ ID NO: 14457 - DNA, 1601 bp, Homo sapiens
cgcctcccccagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataatt

SEQ ID NO: 14458 - DNA, 1161 bp, Homo sapiens
tcagagactgacagcgcgaggggcggggttgggagtcaggatggggcgaggcctgcgtgtgactgatggcgcgggggcggggcggcgtgtgtgtgactgacccgaccgcgcagaggcggggtggcacaagatttgcgtttccttgatgacttctaaattatgattatagattttctttgtaatgaggggaaaggtttttttttttttttttttttttcccgtttttgaaatccaggcctctgtattgcttcactttaggtattaagtataagcacaaaattaaatgtaacacataccaaattgtccaacttcaaaggccattttgtttttgtttttgtttctgagaacgagggggccacagtaaaaactttggtgatttttaccagtggaggggctagggaggtgatttttgctgtttaaggaggttctcaaatttacttacctgcagtccattttcatttcagaattgctaccagaaagaaattgtaaaagttttcaagcatgattttgtaaagcaaaagatcaaaaaaggagagaaattatgtggaaaattggcaagattaattatatctctattaagaccacctttgcgcaagatagttttgggttattactgctgattttcagcctttaaagaaaaatgtgggttcttggtagcaacttacaaggatggtgtttagagctatagttcccccttctccaccataccctgttttcttgatggttaattttacttttaaaaacatttgtatttcttgactatttattaattagatcattttgcttagtcatacctaagagttttgttagtcttcggtttcttagttgtatgagtcagagtcaggaatgcaaatttattagctttttgtggagagggatatgtgggatggtgagagctgcgggtgggtaagcatggagtgcaataccagttcatagacaaggatctaaaaggagccattaagctccatggaaaacattgttacttgatcaggccagtaaaggaagactattttgagtagctactgaagttatctgatagttaatttaattgatttgagtaactctttcagggaccccagatttgtaaaagtggcactgttgtgacttttgataaagggagttttagcctttcatgagaggaagccttggacttatttgtcc

SEQ ID NO: 14459 - DNA, 1537 bp, Homo sapiens
tgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggagaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaa

SEQ ID NO: 14460 - DNA, 1185 bp, Homo sapiens
ctgctaaaattgaagaccttaaagagttatatctgttgatatttactgtattataaattaaaactgagaaacttaaaaatattcgtgtaaaaaataaaatactcatcaacatagcagttttggaaatgagcaatagtagctatttccaaaacaataaaaattagtgagaaaggtggcattggcttgcatttttagggtctggctatttaagggaagacatctaggttttcatatctgcttcttcatttactctgttgtgatacatggtggacattatatgaagaaaacctcgtttcacactgacagataattgggtaaaggaggacctcataggtcccagaaagggtcctagctctaccaggggtccatgggccacactttgagaaccactgtttaagcagtcattcagtgaaatcgtattcatttttgtcaagtgtataattaacaaggtgatttgtcaccgtgaatgcattccttatctattgccttgattccatttgtttaattttttcctttcagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatgtaagtgatttcacatagttaaatttgattatgaaaattgtgcggccgggcgtggtggcttatgcctgtaatctcagcactttgggaggccgaggcgggtggatcacgaggtcaggcctggccaatatggtgaaaccccatctctactaaaaactacaaaaattagccgggcgtggtggcacacgcctgtggttccagctactcaggaggctgaagcagaacgatcacttgaacccaggaggtggaggttgcaatgagccgtgattgtgtcactgcactccagcctgggcgacagggcgagactccgtctcaaaaaaaataaaataaaataaaaaaagaaaattgtgctacttgtaaaaaaaaatgactatagttttacttctgttgatgttttttgaaagacttaattctttctcattttaagctgggcagtgatatgaataaaaagatcacttagttgcc

SEQ ID NO: 14461 - DNA, 1178 bp, Homo sapiens
ggccatccttgtgggcgtagcagaaggaagaataaaagcccttccaggagagaataagacaaattaacaaacagaatatgaagagtattattagagagcagattagctgatgagctggtggacattgttctgaatgtacaaaaaaaaatcgccagggaaattatcagaataaatttgtcagaagatataggaaaaatgataatgagtgtgttactccttgactactttattttacacatgtatgttgcttgaaaaatacttcaactgtgacatttagtttttaaatgttatccatgattcattgctaaaacgactattcttttactataaaagtgagttcagttcatatattagggttaattttatataatatggcacagagggctactgtgtctgttactcagtgtaaatcttggtattgctttttaaataatgaattcataatgcaaaatatgcaaaaataaaaccagcaatattatttttgtaaaaattttgatgttgtcttggttgtgaacttattaacttctaatatttgaaatgtatttttaacaggtagaagtataggtacagataatgtgtgtagagatagactggaaaagaccatcattctttttactaaagtggtaagttttttaaaaacttgttttctcaaatataatacacatattcagatttacaaaggaaaatgatatttttataaccatacattttcactttagtgtaaggaaacctatgttctgactccttataggaaagctaaaaattgcttttatatgtactttagaatgcatataataattaaatttacataccatgtgtcatagtgtaagtcaccttggtacatgaaaaataaattctaataaatattagagtatttgattcctctaaagctcattattctttgacccactggagaaagtggagataaagaagatagcagtgcagttcagctagaagtagatcaaatgtagcagacaggaagtcagtatattcagaatgaccatcagactatcttcgtccatactaagcatcttttgagtggaattatagggggtgcgctgtggtaggcagtgtgtataattacattttataaaacattaacttttaatgatattttggtcttgaaggattgggagaagtgcaaataattgggttacagcagttagaaagacctagct

SEQ ID NO: 14462 - DNA, 1215 bp, Homo sapiens
gactaattgaatgaaattttctttgacagatttttccaccatgagattagtacagaatctgtgtgagaagagaggcagaagcaattttgttactgtagaagagattacaaagaacttttgtaaattgcaggtaggagagacttgttttgcttttttgacagtcttgctcctctctgtatcccacagctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctca

SEQ ID NO: 14463 - DNA, 1815 bp, Homo sapiens
tcagtatgtattattatccataggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgc

SEQ ID NO: 14464 - DNA, 1176 bp, Homo sapiens
tggaaaactgtggctaatagaatatatttcttcaaaatttagctttactatttttaagtgtatgaaatgactggagccaaagccaaataagtgtctgttctaatgactaagaataatttgcagtttcagtggttgcatgaaattaaatatttctaaagggcttaaaaataattgtttcattcttcatttgtttatcaagtttcttttttcagtgactgcacagtattaatctttattccagaacctttctgcccgatcacaagttaataattggtaaagtctgaattgaggctttactttatgtgaaaggagaaataagattagagtcctctctggtttatggattatcagtgtgggattacagacaccccttcaccccactcacttattcatgacaaggtgcctctcccacatgggttagctttccttcattatttatttcagtatctttctactacctgataaaatctcttagaatcatagaattttatagctcaaagggattttgtccaacttcttttctttatagatgaggaaactgagcctctggttaagtgacttgccagactgacttcatttcctttttgataggattgcatgatagggagatgccataataatcgtatcttgagttcagaaaagcaaattgtgagactctctcatgatattcttgtagacaacaagaagaaatgtgatctgggagatagtacagtcagatagatttatagctaattgaatacttctgaccaaagggtgctttgttgtcaactcatgccaatttgaactagtaatttgaaatgtaataggagtacatgtaaattctgtacttgagttcaataaaatcagctgaataggtatgacataatagcctgtgagtcctagttgaattactaagaataagatctctggaataaggattttaacatcctctgcattgtttagatcatacttgcagcattttatccagttgtgaacgtacttaaggaagatcttgacaaactagatgcatccagaggaagggaaatggtggggaagacgggaatgatgccaaaaaccacctaacatagggaatgcaatgaggaactggatataataatactttagagaaataaaactaagtgaaaatatgatcctagacttcaaatatttgaaatatttttatctggaatattgctc

SEQ ID NO: 14465 - DNA, 1328 bp, Homo sapiens
attcagtgttgaataagaagttaaagtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaattctaaacaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttctatatatgcaaatgacattttcatttaatgtaccaaattgtgtatctaacttttataatataggttaaacagatcctttctaagatggcattatttaatctttacttaaaactatgaaaaatatgtgtaagttattgtttataaacagaagagactataattaaaatatagagcagattccaagtgaccatcattttactttttagatttaaaacagaatgaaacagaagatttagtcataagaagatgcttgaaaaacaatccaagtatccaatgcagtggctataaaatattatttcatcatttaatcttaatcattttgaaacaaagacagacttcaattt

SEQ ID NO: 14466 - DNA, 1088 bp, Homo sapiens
atgctcaggttttctgcatagttcttaactaatcttgtctgcagtttggtattgataatattagcatggccacttatgctaaatacacaataagatacatttagaaatccttaatgtactggttaggtcagtggtacaactgtttgacttaattatcacaatttccccaatggtaaccttaccttggaaactatcaaatataaatatactttaactaagccagtgacctggtcctaagttaaggattttctaaatggtatttaattgtgtgcccataaacactgattttttttaaaaagaaaacttagtaattatttgatggataacaaaaagcatctatcactaacattgcttgttcatgtaatcttctgtgataatttggcttggcatgccagtcttataattaacataatttaaatttgatgcaatttaaatataacaggagacttaaaatattttattataaattagatgccatattagttagtggagaaaaggggcattaggtattaattgcatgggtctaactacattgatgatgagagtttaattccaactagagtatattttttgtttattaataatgaaattggtgctgacatgtaatgacttcacaagttttacgagggaaaactgaaaaaggaagtaatataaattttgtggggtttttttgagatggagtcttactcttttgccaggctagagtggtgttgcaatgtcagctcactgcaacctccacctcctggattcaagtgattctcgagccttaagctcccaagtagctgggattacgggcgcccaccaccacgcccagctaattttttttttttttttcttgagatggagtctctctctgtcgccaggctggagtgcagtggcgcaatcgcggctcactgcaacctctgcctcccgggttcaagtgattctcctgcctcagcctcctgagtagctgggattacaggcacgtgtcaccatgcccagctaatttttgtatttttagtagagacggggtttcaccatgtttgccaggattgtctcaatctcttgacctcgtgatccgcctgccttggcctcccaaatgctgggat

SEQ ID NO: 14467 - DNA, 1188 bp, Homo sapiens
ttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaat

SEQ ID NO: 14468 - DNA, 1242 bp, Homo sapiens
atggtgtgattaattttaatatgtaaaatgattgctgaagttgcagtgttagccctctttgtcacctaagttaatttttatccttattttgttaagtgcataacatttaaattttggtcgtgttttattttgtcagttttaagggttagagtttttccttaggaccgtgatttcagtttattaatagctttactaccaccaggtggcagcaagttgccatagtaacagctgtacaatgagaacaacttttgagatttaagattatctaaacccacatcctttacttcagatgataccatgactgtaaatggaagttcctaacttatactacactatcttaaaaatactaaatatatatattagcaaatttttgaagatttttaaagatggttttttaatagaaaataatttgagataaaggaatatatgtttcccatttttaaaacttgtgctttagtagtttatttttaataccagcctttgactagataataaaagataatcgtagacatttattgtgcactttactgtatgccagacatgatgtcagtagactttttcatgtctcaccttatttaatcctcacaacaggcctgggagaagattattatcatcactgttttaaaacatgaggaagctgacgctctgtatgagaagtatagtagcccttttcctttattttagagattaagtttgagaattctctagtacttgtacttacttttaaaaactacctcagaagcataaagttgaaagcagtagtatatgttaaaacaaggctcaaaataaacagatcactgctggatttcagcacattgaaccacagattgaagaattaatgtaacctcctttgctgtgggtactggtttgagccttgtaaccacacctttactgcaaagtgattttattgattctgtgtcacacatgcctttgtgtttctgtgattgtttagacattacctttcacagcaccaaatactattttcattcctttttaataacgaatttactttttttgatgacatgggaatgtttaactttttctcgggccattttaagttgtttggtgtagaggaaagttcaagtgttcacattcattcctaaatatatatgtatatattttttgaaacagagtcttgctcatcgcccaggctggagtgcagtgtcatgatcttgacccactgcaacctccccctcctcggttcacgtgattcttgtacctcagcctcccgagtagctggga

SEQ ID NO: 14469 - DNA, 1601 bp, Homo sapiens
atggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcatgtttgtgtggtgtctataaaacaagtcatttaaagtatgagtgttttcttgtactctggacctattacatgtttctttatgttggtaattaacatttaatttggttcttgctgctaattattttctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattttgtttttttctttaagacttctttttt

SEQ ID NO: 14470 - DNA, 1194 bp, Homo sapiens
agactttaagactttaaattctctcatggtttttctttgagtttaaactcagatagtgggatagctcctgtagatgaggctttaaataattgccacatgtccttgttccagcggcgaccttacactcaagtgtgtgtttttaggggcctctttgtttttggaactcagacccacagagtttgtggacggatgtctgcatcatttcaatgtttttatttattatgctgcaagctgctggttttctctcctcttctctgcttcctctttctgtcctcctctcatgagagggttaatgctgcattgtggagttagtgcaatttgttcttctaagagatggcaaaggccccatcaaagtagtctatagtcaagttctagcaatgacagtgattccttcagagcctctcttgatatctctttagggatcttctgtggtgtttaaaaggaaggtgaaatatgggttttaaaaaatgataaagacagtcttaccagttgatttcataatgagaggtgtaagccattgctgggatacatcggaaggtgctcgctttgtactcctgaaaaacctgtaatcagatgggcactgtcttgaattgttaaaatactgttacctgcagtttttagaaatttattttgacatttaaggacatctgaaggtgtatatttaattactactgctgctttcttttcatttgaatgaaaagtggtggattatataacaattgccactaagataagttttcttaaatcagtgtcatggatgttcaaaattttgtttctaaatgtgtaatacagattaataacttaaactgttagatcttgggcagtcagaataatttgaattttgaggggaagctttaacagcttcccacttaggatgccctagaaaatgagggcttgattacagcaaggttttatgtgtatggcttgttttaacccaaattcacaggctggagctatatctctggcagtgtttaaagtactggggaggtgagtgggttgagccaaatcagcttctgaggtttaggcttcttttttgcagtgtttctttttctttcccttgcctgttcacttgaacttctgaagggcagaaaaggaggaaatattgttagagtactaggtgggtgaaatgtagggtcctggagagcaagggtattatctttgcactgcttcacataacgagtgctggtaaagact

SEQ ID NO: 14471 - DNA, 1297 bp, Homo sapiens
aaaccctatctctactaaaaatacaaaaattagccaggtgtggcagtgcgcgcctgtaatcccagctactcaggaggctgaggcaggagaatcacttgaacctgggggcggaggttgcagtgagccgagatcataccatgcactccagcctggagcgagactccatctcaaaaaaaaaaaaaattacaaagttggcctcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattc

SEQ ID NO: 14472 - DNA, 1813 bp, Homo sapiens
atctcactcagccacccaggctggagtgcagtagcaagattttggctcactgcaaccccaacctcgtgggctcaagcgatcctcccacctcagcctcccgagtagctgggactacaggcatgcactattgtgcctggctaattttcagtagagacagtttcactatgttgcccaggctggtctcaaaaggttaatcatcattgagatgggctgtaaatgtaaaatacagacagaataatgtgaaatatgtcattagtaatgttaaactgactgcacattgaaataatatttttgatctattgggttaaataagtatattaaaattaaatttcactgtttcttttctgtaatgtgaaaacgacattttaaatgatgtcttttgcccttgtggcttacattatattccttttggacagcacctctctaaaatgttagtaacttcaaaaaattatttatttgcaggtgaagaaaaaactccagaacaaattatgcaagaaaagcaaatcgaagcgtatgttatatttaaaaattttgtttatggtctttactaagatttaatcatattttctattattttgttgttagatggagtctcactatcatgcaggctagagtgcagtggtgtgatcatagttcattgaagccacaacctcctgggctcaagggatccactggcctcagcctcctgagtagctggaactacaggctcattgtaccacacctgactttctttcttttttttttttttttttaaatattttagggccaggcacggtgactcatgcctgtaatcccagcactttgagaagccaaggtgggtggatcacccgaggtcgggagttcgaaaccagcctgaccaacatggagaaaccccatctctactgaaaatacaaaattagccgggcgtgatggcacatgcctgtaatcccagctactcgggaggctgaggcaggagaattgcttgaacccgggaggcggaggttgcggtgagccaagattgcgccattgcactccaacctgggcaatgagcgaaactccgcctcaaaaatatatatatattttgtagagatggggcctcattttgttgcccaggctgttctcaaactcctggcctcaagtaatcctccaccttggcctcctaaagttctgggattgtaggcaagagccactgagcctggtcataatctcatttttctatgctatagcattgtttttatttttcctttcctttatttttccaaataacttgtgatgcatatattgggaagttgttaatttgggatggagatttatatgtacacaagtgatcacattagaactttctggcctccctttttataagatactaagtgaagtagctgaggggcattagtttaccaaatgtgtaaatacacattggtatattgagcctgtagaatacttgtatttagatagaggtgttttacttttttaagggcttattttatacatttatttcaataatgtctttttctgatattgctgaaattcttttgctcatgtttctttgatagtaaaattgaagacctggaaaatgaaattgaagaggtaaaagttgcttttgagataaaaaagcttgcattagacaggtaattattacattttaaatataagcattgtgaactgactgcaaaatgggtatgaggggaaagtggagggaatcttttaactgggctgagtgaattagtcaagcacagtgatgattagataatggtcacacaaaatttttattttattattgttataattttttaatttgacaaggtctcactcttgcccacgctggagtacagcg

SEQ ID NO: 14473 - DNA, 1270 bp, Homo sapiens
tagttaaagggactagctaaacagcacaatgtaggtaaatgaaagatggcttcataatcatcacactcatggtgtaatttaaaaatcttctcctttggttcttattaatgcctgcactgtgaatctgacagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaattttgtttctcctgtcttttaacattatctagcacgcactcgctgccatgggtccttaagcacagtgcaccaatctccctcccccagtgtcaaacttttcaaaagatagggaagaggatggcaacgttgcgatgagaactgtaaactctttccaaaagagcccagtgtgtggtcattgccgcgacgtgccggctggtggcaccgagcagcctgggcccagagcggttgtcgggccgacagatccgggcggggcaaagccgggcggggaaagctgggctcgtcccgtcccggccccgcccccaccccgggagcccgataccggtttcagagtcctgggcagcgtgcgcgctcttcctggcggctgcgca

SEQ ID NO: 14474 - DNA, 1270 bp, Homo sapiens; identical to SEQ ID NO: 14473

SEQ ID NO: 14475 - DNA, 1240 bp, Homo sapiens
tctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagta

SEQ ID NO: 14476 - DNA, 1240 bp, Homo sapiens; identical to SEQ ID NO: 14475

SEQ ID NO: 14477 - DNA, 1189 bp, Homo sapiens
cgtgcccagctaatttttgtatttttagtggagatcaggtttcaccatgttggccaggctggtcttgaactcctgacctcaagtgatctgcctgcctcgtcctcccaaagtgctgggagtagaggcgtgagctactgcgcccagccggttctgtgtcttttatccctttttcttctaataattttcagttttgtgtttattttatcttcactttcatattacaggaaagaatggtccagaattaaaaacttactatgaaaaatttgtaggtagataactaagaattaactctgagtgagaaactagtagttaattccttttttattttcacagcataagattttaaaagaatgggtggtgggaattttcattttaatgactggaactggaatttcactctaaaagtttggttttcattaaaattatccttgcatgcatatgaccttattgttgttttgattaaatatctagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagaggttcggtttttttttaaaaccttggtactttatcttacttggttttcacctcttgtttcttttaggggatcattatttcttctcgtagtgattattaggatttgaagagttcattctctaaataacctctaccaaatataatttggggccttgtataaccttttgtgattgctcagtccctatggcccaggcccagcaagggagtcagtgtaacaacgagagaaatctgcttacacttgtacctggaagctgtttagtctactttctgataatctttctttttttttattttttattttttatttatttattttttatttatttttttttatt

SEQ ID NO: 14478 - DNA, 1166 bp, Homo sapiens
tgcttcctattttattattataactaatgctacaaaggttatcttagtcataaaactcctactatgtttaggattatttacttaatgtaacagcatagaagtgaaatttttgggtcagtgattgtgaacatatttaaagctcaatatttattgccacgttgcttttcaaacagatcatattggtttagactgctatatatacacacacatatatatataaatgttgtattacagttttatttttactttatttttattacctttttaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaag

SEQ ID NO: 14479 - DNA, 1648 bp, Homo sapiens
attcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatg

SEQ ID NO: 14480 - DNA, 1142 bp, Homo sapiens
atggggctgtaatgttgaagaacaagaatacaaaaaataaatcttagtactaaaggtcagttttcatttttgcaaaataccctcctaaaaggagactttgaaggtttattatgagggaattcttttcccttgagacttggattttttttttcattattattttcatcttattaggaccttttcattcaaagaaccattatgacacaaggcttaggttgttagttttttattactaatctaggactgatgacttttcaaaaaccaagtgtgagtttataaacttgttagaagtaattgttttgtattatataaattaatatgtgaactgtgattaaagtttgcatttatatcctaagactgctgtctgctaatggatgttaatagtgatacgtactagaagttgaaggttgtattggggtatcttgtaatgagtgtaattagttttgaagaaatctcttaaattctctctccaatgaaatttctgcctttcagagtagaatgcatgattattgccaatgatgccaccgtcaaaggaggtgcctactacccagtgactgtgaaaaaacaattacgggcccaagaaattgccatgcaaaacaggctcccctgcatctacttaggcaagtcaccagagtggtaaaataaactattattagctggtaaaatgcaagatagtttggaaggctgtatgtattacatttgggatgggtattttataaacctgttgatttctcctgtaattataaaggaaacacaggttctttgctgaaaactctgggggaaagtaaacaagaactgttcatagtactagtgcataatactcatacattttgacgcatgccagtttttttctctatgtgttgtgtggttttttttttttgttctctagatcctgtttttcttttaactttatggatcatactatgaaaaaaatagtagcaagtatttatagatctcttgagtgccaggtactgagttaaatgtgcaagtattatataatttgagcagatgtaatttaaagtaaatttaatttccagtgaaagtaaacttatatttgaaattaaaacacatttaaatcaaagaacctgaaagcaaagcagtttaaaatgggcctttcctccgggcgcggtggctcacgcctg

SEQ ID NO: 14481 - DNA, 1134 bp, Homo sapiens
gctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaa

SEQ ID NO: 14482 - DNA, 3276 bp, Homo sapiens
ttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcactagtcagctggctctttttcctatgaaatctatcagtacctttctccatccgttgttctcaatatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagttcatgtgtgtgctgtgctgtcttttgctttgtgttcctgagttgggctttgccactcacgcagaatgctgggcagtcagggcatgacggcagggggtgactacgttcttttcaagatgggctccctggcttttggcaaactgccgaaagcatcttgctaatgcttgcaactgctacctcgttaacttttatagccaagctctagaggatgtgagcgtgtaaggacagaaactgggaggtgaagggaaggaacaattaaaattattgcttaaaaaaaagaaaaaaaaaaggatagctgggtgcagtgctacatgcctgt

SEQ ID NO: 14483 - DNA, 1191 bp, Homo sapiens
cgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaatgattcttatatccctgataagtggctgaattctggagaccttaggaagtttgaaaacattgcattgcatgtcatcccttaaactaaatatcccagattttacttatgctaaaattgtgaagcagcttttaaaacattagttcttcctgtttgacttgatagtttatttcaacatttagttaattgctaaatgactttgaggaatagcttttattttgttgaaatacacttttctgtagatggtgctgaacagatgagagctttgggggccaacagtagaggaactctaacactgcgatccactcttcacttttggcaggtgctttgcaagtattgatagagatgaaaaaccaagatgtgaagttcaccaaagatacctatgttcttgcttttgcaatttgctacaaactggtaagactctttcctcttaactttgagagcattgtgtgtagtctttgagagaggatttttcttctctctacaaataaaattcagttcctctgaaatctgttttccatctggtgcaaatgttttaattttaaatgtttttatttttagaaaactcaagttagccatatcaggcagttttatgggaaaagtaattttttcatctttcactcttctctggtgattgtgtagatagtgagaacaagaggcaatgtgttgggttcaggctctgctttaaagtcatcacgcatgctggactctgctagatccatcttccctgttgtccttgtctatggaaatcttagcttccttcattggtgagctcaaggactactttgtcctcatatgtgaaggcttttgcaatcaccgaaactggaagtgatgtttgtcacctccagatatcccttaattttgctctatttgtgtcacctccctggtacttctgacacagcttaatgtacttagcagatgcacgttccattctctccacttgagtgtgagctccttgaggtttctttgtatcccaccacctaacacagtgcctggtatccagtagttctttaataaacgtatgtgac

SEQ ID NO: 14484 - DNA, 1152 bp, Homo sapiens
cctaagtggtatatggagagagatagctcaaaggggtgttttgttttgttttgttttgtttgtttttgctaagctgatttccattgatatcaaaagtcaggactggtagaaacagaaaaacaaaacagtttcatcttaagagaaatacctgaagaaatggtggcaaaaccagtatcattttaattaattaattaatcacaataattcttaattcttaataattattcttaagtctatttacaagactacagagattcttctacactcggtgttggattaatggaaattttctactaagaaccagctccatttactaatgctcatttgtgcatctggtacatgaagcctgcactgaagtagaagttcaagacctttctaattcattagtcagtgacttattgattctgaaagctacagaccctgcgccttgtcatcattttcataaagcaatcctcagggtagtgttcactgtaaaatattgagcttattaagagtttttgggcctcggattaactttcacagcaaaagctatgttaagtaaattaggtaccaaataaatctaaaatgattgtagaaagtcatcagctaaattaagacgctgacagctcacataacaagatgcaaagcaatagtaattaagaaaaataatcacctctgctgctgagaggatacgtttggccccaggtgaagtagctcccaaggcatctgctttctaaaaggaaagtcttgctgttttgttctgctgtgaaggggtgaggggcaagagatccttttctgtattgcagcattcaccacatactctaaaggagagcattatctttgggaaataatcttatgtggggcagaaaaacagatttgcagaattacccaagatctcttatagccctagtgtggcaaacattgtgaactggccccactggcacacacaactcctttctccctgctttcctctaatggagaagtaagaagatgaaaacattcacctcttagactccttcgccaggagtagtggtcatgtgacccagttctcgtcaatgagatgggcgtgggagttgctgggtagagcttctaggaaagcttttaaaacggacagatgagactggatgcccattctgccttttgcattcttgtctttctcccttcttcctgctt

SEQ ID NO: 14485 - DNA, 1267 bp, Homo sapiens
gggggctcccgtcgcctccgcctctgcccctcccccatcctccgagaccggcctcctccctgggtccgggcgcgggggaagccgccgctgcccctgccgggcgactcgcgcacgcggccctggtgcctgggccgggggcgccgccgcgtggggctcacgccgccaaggccaccggcttccggcgcgcaggaggcgggggcccccggccgccgcccgggatcgcgacatgtgcgcgggccgggccgccacgtccccgcccgccgctgacctgccgcgggggtagggagcgggcgggcgggagcggcccgggcccacacaatgcgccccgtgggtgggggtggcaggccgagcgggaggccgggtggagggcgctctgtgcgcggcggagctcgccgcctgactggccagaaatgggtggagctggcgcggggtttgaactgcagctgtgtgggtcttgggggtttttccacgtccttgccctaaaaaggctggggacctacaggtgggggaaaggggtctctgtgcctcaccctggggttactggtgttaacacctgttgcgaactccttgtcacccaagtgagattttctttttaaagctttggctcaaggctgactgcacaattatgtaggtctttaccgagtgtgctggtgtagtgatcctgttgctacggttttagagacaggaaaggttaagagaaccaaaactctaccacgtatgctttctgtagtgccctaaaccgtgctcaaatggagagctcttactggatgcagtaaaggaaacattcactctatatcatgaataaccttttaacccccgttttaagcctaaagaagttagttaagtctactattttttgcagaaaagcctcttgatttttattgtcaaaaagcagcaaaattacttaatatggagtttggtaagtaagctcttcgtgtttgagtttatttacatttaaaacatctgtaaagatgaagttatttaccccgagggtttcgcagaaatactgcattgccgtaatttaaaaccttcaatagatgacaaaattagtacttaccttcttggttaatgtagtacttcccatttaaaagtggaagggataatgatttagatctgcttggattttttaaagccattttgtttggatacttctagtactgaggaaagaacacttttggaatgtattgccgtttgtatcttgtaaacagtgctatggctcagtcttaatttgtgttgtcatagttctagggatgatagaagttgatag

SEQ ID NO: 14486 - DNA, 1239 bp, Homo sapiens
tattcttggtattatggcagaaaaagaagttgcattcttatacttggtaaatttaactcaaaaaaccttagagggtgaaatgttgaaaaacactattagaaacagatctggtttatgtgaggttttttttccacaaggtacggaatggtgatatgggtgttggtggtgagtgttactaattttttgagacagggtctcactctgcccaggcatgagtgtggtctcatagtcatggctcactgcagcctcgacctccttgactcaggtgatcctctcacttcagcctcctgaatagctgggatcacaggcgcataccatcacgcccagctgattttcttgtatttttagtagtgagagggtttcatcatgttgcccaggctggtctggaattcctgggctcaagagatctgcccgcctcggcctcccagaatgctgggattacagcatgagccaccatgcctggccaaatgttattatttacataaaatgtgtttgtgcacacagttgctcacatggcaatgcctgacataatgctgttggatttcctaaagaagtgtgtttttgttcaaggtattttgatcacaactatagcctccaagggagaattgcagaattggcctgacctcttaccaaaactctgtagcctgttggattctgaagattataatacctgtgaggtaaggatatttgtttcatacataattgggtgttttctgtttttcttgtcatgttgtgtattagcagcttttgggaaaaatagttcctctgaaacatacagcttctcaaaacttagaaacctaaagttacctttgtgttatattacatttgtaaatcatttatttttctataaaaactgttacattataaacctcttttactgtatttcacacaaggacgtatcttgcttttctgttctaaaattattcttggatgtatatgtatgtaatatacagtttttgtcaagcctaatcagttaaagatagaatgaaatttaccaaattcctggaccatgagtacttttttagcttctctaaattgtttttatgcctcttatatgagatatctaagggatgctgaacttgtgttttttgtttttgtttttgttttttgagacagggtctcactctgtttcccaggctggagtgcagtggcaccatcatagctcacctcaacctcctgggctcaaacaatcctcctacgtcagcctcccaaagtagtggggactacaggcatgtacta

SEQ ID NO: 14487 - DNA, 1160 bp, Homo sapiens
atctttggatttggccaataaaacattcattgagaatagatctcctgtaaatagacttcctattatccataataggatagaagcataagtttaagtaatgataaattcttgcttaatttggtactagatggtgacattggtagggttattattaatttccccttaattacttggagttattttaaaaacattcttatatatgctgctctgaatttgattcaggtaacttagattataccagccagtggaggccatgtagttggctgaaagggccgtataacctaacaggtgtgttaggtcagtctattcgcccctccataaggaatatgttctgtacatgggcgtggttcttaatcactctggaagtatatttcagaattctgtgcatgaccccatctctggatattctgtttctcttactcatgtacatactattagcctataatgaatgccaccaaaaatttctcttaaaaaaacaacagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagtaagtcagaaagggaaaagcacagttgcctactttgatgataactttattggggtataattcatctactgtacagtttactacccattaaagtatacatttcattggtttttagtatattcagagagctgttcaaccattaccacaatcagttgtagactatgttttcatcacccataccctttagcagtaactccctattgttcactggctctgggcaactactagtcaatattctgtctctgggtttgcctattctagacatttcatgtaaatggagtcatacaatgcattgtcctttgtgaccatcttctttaacttagcataaagttttcacggttcattttgtagcattcacttgtattgtgaaataatatttcattgtaatatgccacatattctccattcattggttggtggacatttgtgtttctctttttgtagctgttgagttgtgatgctataaatactcatgtataatttttgtgtgtagactttttttgtttgtt

SEQ ID NO: 14488 - DNA, 1352 bp, Homo sapiens
cagaaatccagcgatgctcaagtcccttatataaaatgatgtggtatttgcatatggcctatgcacctcctcccaatatactttaaatcattttaattgtttttctaaatacttttgattcaagattggttgaatccatagatacagagggccaactgtatatatattactttccggcaggatctcagaatgtgcccagtaaagtccattcacaacattgaccaggatgggagcatgaaatgaatctcttcaatttgagggaaaaatatgaacacataatactcaatctgtcctttaaagataatgtttcttgtagaaacgcttcctctgagtaaacctgacctgattggctggcaaactaacaacaatgaatggcttccaaaagagagggttggggtggggggaggggaacctgctactgtagaaactagtagagcaagctcataaatgatcaggatcctgttgagcgcagtttcaagcattcatcataatcttcagtatacccagaaagtttagcatgtgtactttattcttcctagtgcctatcttcagttgccacagcactgcagtctggattccttccgtactgtgaacctgtgtatcagcgttgtgtaaacctagtacagaagactcttgcacaagccatggtaatttttttaaaatgtcttcctcttcttgacatggtggacatttttctaaagataggtataatgtatacagactttttaagtagttaattaaaaccaaacttacaaaaaacattgtgtctaatttcagctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctatgaatatggttttttaaagttaacatttacatcagctttgtttttttattattaaactgaaattgcatggaatcccaacatttataaatgtacactttattggttaaagtaaacttgctgtgattgaaacaggcaagatggcaggaacccctaatatttccttgagcttgccatcatctcagctttttaggtactcctgtgactggaggaaagcttagtaatatac

SEQ ID NO: 14489 - DNA, 2462 bp, Homo sapiens
ttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattct

SEQ ID NO: 14490 - DNA, 2373 bp, Homo sapiens
ggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagatgttgcactctgatttttaatgaaaggaaatgagttttctttttccctcttaccccattttggatctagataagccttatgttttttgggatttttttccttgtttttagtttgaggttttgttttgttttttccttagcttacacattagtacacttttgttgttgaacatcatttatttcttaaaacaagtgttttcttatttgtatagtatagtaaaaacctgtttttccacattttaacttaactccttgatgtgttttaaacagttgattataggttctgctgtttgaggataggggacatactattctgtaaaaggaattaaaggcgaaattgtgaatataaaaagttgatgtaaggagagattgcatgagtgtgtatgaatgtatgtcctattaaggcttcctctttatccttcaaacagttaagatttgtaatttggggaattaacatttataagagtaattttttcttcaggttgta

SEQ ID NO: 14491 - DNA, 1508 bp, Homo sapiens
ctcccagctagattatttttatctttttattttgaagaattctaaacaaattgtgtgtgtgtgtgtctgtgtgtatacacacatatacatatatatacacatagatatatacatacatatacatatacatataaataccatcatggtctctcattttggggtctcatcagtcagccccagcagcttgccccagccaatcctgcccatccatttcctctgcccaaattctagaatattataatttcatctgaatttacattatatatatctttacacttgatcttagccaaaaggccaagaagcgatacatcatatatatctttaaaacataatcacaatatcatcacatctagaaataatttattactccttagtattttgaaataaccattcagtatttatcatctttgatgtccattttattatgctttgtttgaatttgttgatatgtcttaagtctctcttgatctacaggttccccttccctccctccctctctgtttagctttctgctatttatttatttatttatttatttatttatttatttatttattttgacagagctcgctcttttgccaggctggagtgcagtggcgtgatctcggctgactgcaacctctgcctcctgggttcaagcaattctccagcctcagcctccagagtaactgggattacaagcatgcaccaccatgcccagctaatttttgtatttttagtagagatggagtttcaccattttggccaggatgatcttgatctcttgacctcatgatccacccgcttcagcctccaaaagtgctggaactacaggcgtgagccactgcaccgggcccgctttctgtgtttttattggcaagactaagtggtttgttttatagtttcctttagtctggattttgccgattatattgccatactgtattatgttttacttctttatattatttaaattggcatttggatctagaggcttgatcagatccaggttcaagttttttttggtcttgttttattttgtcagggctgcctctctcatgacacacatggtgtctggttgtcactctttatggcatgttggcagacattgatggtttgtcttagatagttttactagttcacccagacttaaactgcataaggaggtgctagatcttatatttccatacagcttatagcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctaagtaatacctgaggctactttgataa

SEQ ID NO: 14492 - DNA, 1247 bp, Homo sapiens
ttagctgtagaaataaatgatcttttctcatcatgagccctactgcgtggctagaaggataattattttaaatagaaaacagcgtatctatattatttcctgtagagctgagagacatgctttaaacttcaatacatggctacaacatttttcagaaatcaccaaagccaaaaagtaacttctgattcagaatgttaaacggtttcactggcattctctgtcttattaaccagaaagcgtttataagatgagtaatattgaattttacctatttttaagttgtgtcacaattacaaattctattataatttaattatactaaaaattatactaaaaacttttctaaggtgctaataccttttgcagaatcatgcattaaaaataacaagggttgtgggaaaaacagttgaagcagcccactcaaaagctatgtaattttgttaacagaagacttaacagaaactttaacatcagttttattaaaaattctaacagagtttaagagacctagtaaatgaataataaataccaaaataaaagtaaggattttatctttaaagaaatgttgattgtagcttaatgatagggggtgtgaggaaaatgaggataaatgcagggtgctgagttgtggagatgagagcaaaatgcagaaatattgaagaatagcacaataaacactgaggcaaaacaaccaaccaaactgagccaagtgaagaatgtagagtgaatggttatcatgtactgtgatactcctccatagtttgtggaagttactcatattgatgtactttgcattcatcaggtattgcttggtgatgcaaagaaaacatgaaggtgcagcaaaaattgcttatgcaccaacatgagtttttcattaatgatgctattcccctgtttaccacttgcttgtgaaatgaggcacattacaaatccaaaaggtagcaaaacaaactatcttataaagagacttgctccaggttgctgtaagattcttaatttttcaaaatatgacatcctcaagagttaataactactttttgtcaatacaataatcactaataatattcttagaacttgaaaaatgcattcatgattcatcagttaaaattcttaactagaatttatgtatttaaacatttttctaatttttaaagttgcaacccatagtttctcttttctaaacagcaattttaatgaatatcatagtttaattgacttaagtcatttcttactaaagatattagaag

SEQ ID NO: 14493 - DNA, 2379 bp, Homo sapiens
attgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttatcaattggtttatgtgtctttgtacttgatagtaatagctatatcataatgttaggacaaggcaagctggccaagtaattggtttttaactttgtactactgtttgaacaggcgtacagatcgaactgttatttattggttatatagaaagcttcatttggagtatatcccaaagtgtcaaaattgtttaacaagggattatttttaatatattttaagatatatttaaattgatgttaaatttttgcagactttcttcctaaccagttgctcaggaacacagtctcagacagttcaaaaatcataatgttccaaagaattagttaagacaatcaagcctcccaaaatggtaaatttaggaaggagcaaaagaaggaaattagaaaagaaagaatttatcctaactattgaaaattttgggctgggtgcag

SEQ ID NO: 14494 - DNA, 1285 bp, Homo sapiens
ggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaacctttttaaaaagttaacatcataaatattctgataatttgcatagtagtaaaaattagaagttgaaattctacctaaagctgtagttgccgtcaattgtgtaacatgtgacaaaggttttcccatatgtcatttcatttgattctcaccacaaccatccaaggttgatgttattctcatttaacattgagttaacgaaagtagttgattcactctcgaagtccctgagtgtgagctcttcatcctagcactgtgaagtggtttgcctgctggggcctaaactcctcattccctttaacaaagcttcactgagtgctgcagttctcaaaatatgtaacagttaacacatttttcaaacaggttaggaagcaattcccatagccatcaatacttaaattcaggagtacttttttgtttgtttgttttgttttgtttttagagacaaggtctctttctgttgtccaggctggagtgtagtggtgtgatcatagctcactgcagcttctgtctcctaggctgaagctatcctcccacctcagcctcctgagaagctggggctacagggatgagccaccatgcccagctaattttttattttgattttttgagataagaggtctcaccatgttgcccaggcctgaggcaatctcctggtttcaagcaatcttcccacctcagcctccttaatgactgggattaaaggcatgagccactgcgcccagcaggaatggttattatattcattgagataaactgtagtatttgctgtttg

SEQ ID NO: 14495 - DNA, 1234 bp, Homo sapiens
aaatgggtactgaggccgggtgttcatgcctgtaatcctagcactttgggagcccaaggtgggtggatcacctgaggtcaggagttcgagacgaacctggccaagatggcaaaaccccgtctctactaaaaatacaaaaaattagctggtggcagccacctctaatcccagctactcgggaggctgaggcaggagaattgcttgaacccgggagttggaggttgcagtgagccaagaccacgccattgcactccagcctgggtgacagagcaagactgtctcaaaaaaagaaatgggtactgagtaaatggatgagatggatgagagatgcagccaagcctgtgaatggaagtcacaactagagctccaaaaccacaaaatgggtccctatcatagcccattgtcactgaaaggcatttaataaatgtggttgcagtaggaggagaaattctggtgactacaacagataggtaagtcaatctccaggcttcctgaggttttcagcatctcaatttttgctcaaagggacctttcctgggaagtctcatggagaagactcagctccattgcattacagaattaatgtgtgaggaagggatattgtggaattcaacccatctcacttcaggaaagatttaggcgcagagtgttaaggatgatattcttccgaggtttccctgccatccctatgaaaaagttaggcgacagttgattggaggcaggactagaggcatacagtgaggtgtgtcttcaacgtaaggccaaaggctagctgccacattttaaggcccttttcagggggaaggttcttaaaagggctgcctcagcacacaggcactggcatatgtcaccgtggcaggtagacacatattaaaacaaacctcacaaacacaattcaaaacacaccgagtctgtaaggactggttccttacatgagctcatgagttcatccccttgtcaagaagaatcgactctctaggtagaaggcaaaacacttgatcctctccagaaggccacgagaatttaacttctttccctttcagaactgataagatctcacatcaccacgtcagtctggctcacaggaggagtgagacctggctctgctaagaagctggtagttgttagtgggagcttgagacccacaaacaaagggattttcaactacctggctgtacttacatttggttttacttcaggctttcacactccatgcttacctcactgacttgtt

SEQ ID NO: 14496 - DNA, 1229 bp, Homo sapiens
agatgtcaagacagcacgtaatattgggtgttgactttaggtcttatatcacaccttcttcttttgtcttcatcctttcccccacttcctgtgctttccttttgtctcctctcattcttaggcaatgggtttaaggtcaaagacacaggcctgggctcagattcttgccctatcactgaccagctgtgcagttataggtgaggttctcaagatctcttggcttctgccttcttattcctagaaatcagaaaatataagtctctttaaaatgcatctgttttgagatctaaatgaaagcctgaaaagccttttatcacagtgaaaagtgctcaataaatgtcagccatgctcatttaaatggcctaactctggtagtgacatttggggccaaaggatagctcttgatggctgggtctgaaagcccgtttcaggatgaggtagtgtcagctctgttaaggtaacaggattgggcctgagctgttagaaacttggcctcaataagactctagctgaggtatcttttctttctcaagaatctcaagggcttaggccagcacagcctgtgcactcatgcttttaaaaaaaccaaaaacccaaaaccaaacagaaaaatgcagcaacaatagctgcttgggcccacatgtcactctattatctcccaccgttggcctgtgccagtacaatcaattgttccacggtcccatttggtaacttggaaactgtttgcgctgaggatctatgataagcactttggctggaactaacgtccctttggaggtgaggagggagaaaaggaaagcaagatgacctggctggggacaggcaattctctaaatgctggcctaaagggactgagttcttgaaagcaggtgactagaaagagaatattgttctacttccttcttttttctttattctctgggctcacatttctaagatctttaattttcaaaacttaaacaagaaagtgtattaatcttaaatgtctcccattaatcatcaagtccagcccagcgacgagagatagatgactcacttccacaggtgatttcttggtaatggtgggtcaaggtttgcccctccatttcccctactgtctcactaatggagaaagcgtccccttaggaagtacctgtcttggagcaatttgtcaagggaaaattgcaggtgggaatagccactgacaagaaaatatttctcttagggaaacaaggtgagtagcatagcat

SEQ ID NO: 14497 - DNA, 2230 bp, Homo sapiens
aaactgatactatactagttaaataacttggaattctcaagttgactttgtcttcctctttatggtttttcctctccccttcccctcaccctccactgtactacattggattaggtcatgctatggagccagattggtcaactcaaagctctgccatttactagtcgtgtgtccataagcaatttgtgcctttgtttctccatctataaaatgggaataataagagtaacaccttcttcttagaataaaggtaataattgatgtaagtcacctaaaacagtgcctgccttgaatggcagaagttcccaatcactgtgcacaatccaagtatgtagatgtcaagtttactgagtgcctactctggacaaatccagtggtgtcagtactgaaggaatagattccagattaatagaagacattgtttctgtttagcttttcactcctgggatttatgatgtaattggagacatgagacacttagaggaaacagttcacaatgcaaggcatgatgtgatcacaggatcgcaggatcagcgtgctggctcccgaaagcgtttctgaccctaacagcacctgagaaccactgagggtgctttgaaaacagaccactgcctgggccctttccctagaccagttaaacagaatttctgaaacttgaattaattggtgaacccctctgtgcctccatttcctcatctgcaaaattagggcaatactttacctcaaatctattgctgtgaaaataaaaagagtgaatgcacgtaaatgcttgtaatagtgcctgccacacaataaacactcaataaatgtgagctctcattggtgaataaatattcaaacatgaatacctagtagactctgctgaagcttttcagaatgttgatgcctattcacttggaaaactctaagaacgactttctctgctgtccttgttgtgtgaaggctatggcagttttagagtgcttgaaactagcgctccttgttgggcagcataggaggactaggtccttcagttatttacttaagttggtgcacacaatttagagacattttaaaggaatattgcagtcaacagctccacaaataatgctgcagaaacacaaagatgagctggctgggccagtggaggaaaggcaaatgggttctctggtagattcaggaggaaaagtgatcccagagcatgaaggtttaggatattaaagataacgggcctttgctaagtgctaggccttctccaatgggctatacatgcatgattttatttaattcttacaccaaatggatggtggctattatccattcccacattacagataagggatgaaggcccagaggggttaagtaacttgcctgaaggtggtagagaaatgatttaaatccaggctgtctccagatctgctctcttaaccacagcatcacagcctctggacccacatggaagaccctgtggctgaatctgcaggtgggtcacctcagattcatccttcatcctttcctctttaactatttttcttctgttttgatcacctcctcttgaagagtgagggattcccatcctagggatgcaggcatggctgaatgaaacatgatacctgacactggacagatggtatgaacggtggtttattggtacatatgtctgctcaaagccccgggaggaggacacctcatgccgtgcaaggccacatggctgctgcgcttggaaacggagggaacaagcagagagaggcaagctttgtagcatcaggagagtggtgtgccccctggtttgtgagggagaatgtatttaccttgtttgaataattccttggtctggcagggaactgaagccactgctcaggggtaagcaggaactgtgtctggctgctgctttttttttttttttttttgagatggagtcttgctcttatcacccaggctggagtgcaatggcacgatctcagctcactgcaacctctgcctcccgggttcaagtgattctcctgcctcagcctcccaagtagctgggactacaggtgcccaccagtacgcctggctaatttttgtatttttggtagagatggggttttgccatgttggctaggctgatctcgaactcctgaccttgtgatctgcctgcctcagcctcccaaagtgctggattacaggtgtgagccaccacgcctggtctctgtctctctctcttttttttttttagagatgatgtcacccaggctggagtgcagtggta

SEQ ID NO: 14498 - DNA, 1137 bp, Homo sapiens
ccccgtctcttccaagcaataaatgtattaatatggttcacgatgagaaatgtgaaactcacaggagtgaggctcgtaacaccatttcccagcccctccggcgtggatcctttgttggtggctgctgcctgccctgtgctctcgggtcttggtctggagggtgagccctgccctttcttatgtgtctccagtgaagccttctgctcatgctgaaaacagcaaaggtggctggctcagcctatcccttcactctcaatgtctggacaattaatatgtcatttcctaatcagtgtatgttgatgcgttatttattctagcatgatgattgtggccaaagatcacctctggcattggctctctattgttttgtacatattatttctcagcacaggcttgagaacaatgggctcattgattccacctgactcttgggaaggatggactttgccagactaaggctctctgaatgccagcctggaagttcatgaatccccttttaggagtaagctgagcctttgcggttgggagtggtgaggaagggaatgtgcctctattttccttgctatttattgctctgcattaaaaaaaaaatctctttgcttctctgaccagaaagatggtgtttcattgaggtagagcccatagtaattaggccagcaatcagcttgtccacaccaaagtgcatcacttgcattctctgtgcacactctctctgcctgctccaccccgccacatccctcctctgcctccctgtttacgcgtttggttcagaatgcagaaacaatgaaggtgtttagggatcctagcctcacggggtagcaattggtacagagaggctgtgacacagagtgacctggaattccaagtggaagattgaggtacgaggacagctgagattgtgctgtggtcctttcttagctgtattcttgtcctgtgagggtccagtggtccagtctttaactgaactgttgtcctgggatgtgaagattactattgggtggcattgaaaggccccttatagagggtctttgatatttcttggccactgccagacttgaaacgttagttttggggatgtgtctccttagcagtcactaccgaggggatacaatcaacccagtgctctcttttggtggc

SEQ ID NO: 14499 - DNA, 1115 bp, Homo sapiens
tgaggtacgtgtagtggttaatgctggttgagtgcttaactcccgggtcacggcctgacccagagccagcactggataactgttagttacccttctctaacagtctattcttccctttgcacctgattcaacctcactgcagtaattttcaactttatcatatgagaatccagaatccttgatatttggcactagaagccccttgacttctttctcttctagtaatgcactgctttcctgtgcactgctcatgatagctttagtgtcttgtccaggagtgtgcatgtcttaaactcacaaaaggaaagctgggtcacacagcaagggaggctgagattgtcctgtacaaggtgttttgcctgaacaaagccacgggccattccttatgcatggggtaccatgcttttcacgatgaccctgttctattctgaccttagcagtctggaccagaggatggtgcctgactcaaaaggcagccagtgagaggctgcagtgagatttctgtccaataagagaggtccatagagagtagtaattaatggaactaatcagtctctctgtcttagtgtcactaagtgtcattcaaatatgccagattttagagatgtgcataagctaagaggcacgtagagaggagacaagcaagtagatggcacaagaaacggaagctgtgagaaggcagaagccatgagatggatgcatttgttgaagaggccttagcatctgaacagagaatggctgacttgccattatgggaggaacagcacatgctgttgagggacaagatcagatctctggagctgctgctttgcctagggtgttgctatggccatcctgtatcctggagcatgccccagttctcccctggctgggctgccatctttcttgctcctccgggccccctctatgaaccccttattctgaaggaatgtgcaaagatctctgatcttggtaactatggagccccatttacaaaggaattcaaataatttaggcacaactgagttgtcctgttactaattagagtaagagagggtggctgatgtgcagacttcttccacctggctgcccctcatggagcagccaccctcatggtaggagaaacctactcagca

SEQ ID NO: 14500 - DNA, 3207 bp, Homo sapiens
ggtttcatacttttttcataggccctctatttagtttggtgtttactaatccttagattagacaagttccctctgcattcagtgtttgccaacacacagattttgtggctctgctgtagagaaataagatctcactctcttgcttgattctttgacactttgaactgagggagttggtggaaatttagaagcccggcacacactgctgttggatatcttagagtcttttttcttgcttatgtagcttcaatatgagggctacatccactaggatgtagagcatgattctagaccccgacaacttcctgctcgttgctttcagttcacagatgcaatagaaaatgtgagtggggtggggttagtgggagaggatgcggtggagaacaggtgattggtgttttactctggtaccttagaaataagcacttgcacaatagaacttactgttcagcactgacctaggcctttgagacagggcagacaggggaaggaccagaggccatctcactttctttgccatgtgtgggtttccctgcttcaggagaacacctgtagcttggccactcactgtttctctgaatccaccttctgctgtcttggagttggtgaaaatgtttctccacattttggcaatttgtattcacgctaattttgaatttcattctttaaaacatgtagtggggaatgtatgtatatttactgggaaattgagagaggttgagtcatggactgctagccaggtgtcattgtaaactggaagttcttcacactgatatttttttgtttgacagtttactcccagacactgagctttgtctggatgtgcattagtggcaccatcagcatctgatcatttcttgacacctcattcacccacttatccattgccaggtctttttgccatgggtcttgtgtccgtggtcttctttccatccccaccacttccaccgtggctcaggccttcactgtttgccatggtgtcatgtggttgctggctgcctggactggcaatcaccagccttgcctccttttccatgcttcgtattactgttaaacacactctttttactgccgtgggacagtatcatgggttcctaaaactgctcagtggctcctctttgtgattctaataagttccaggttaacatagacattctaggtacctcatgacctgtacccaacctacgttaccagtcctaacacctttactctattcctgtaccctttgctcttactcaactggcttatcctccattcacaagcatgttctacatttccctgccaccacccttctacttacgtcattccttctactgtgctgggatctgcttctcttttatttctctttgcagtaatcttaatcatcttctagaaccccattaaatgcaatcttttccgtgaggcctgaatgcaatatcttctttctctgagctctgaaactggatcatctattgaatacattctgctttgtgttggagtttgtgtgtgtgtgtgtgtgtgtgtgtgtgtgtgtgtactacctgctacctccccttctagattgtaagttttttgaagtcccccatcacattttacattggttaagctattctattttgctaagccctaatttcctgattaaactgagtgcaatagtagtgcttaacttctaagtttgcagcattgttaaatggaataaatcatctagagtgctgagcagagagcttgacatacaacaggtcctcaacatttattggtggaacaaataaatgaatgagtcttctcgttttctcttgaatcctatattattgcaaatgcaaaatgttttcctatcctaaactttgctaaatttgcagggccctcagtactagttgcattccacatttttcttgagcattgccagaaagtttaggggcaagaagggaatgatcaaatgtaactaccattagtgaaaaccacaggcactgaacagctggataatgtgaacagacaagttcagctgaatctccagaaatgcatcaatcataggatgatggcagcttttggggagagttaagagatgcttgaaaaggagccagagtgtggaagaaaaaagatgtttagagttgggttttcaaaaccaaagtcttcatcatggccaacaaactatgggaaggtggcaaatgtgtgtaaaaagaccttttcattttcttgagttctttagaaaattggagagttttgtttggtttatttatttatttatttttgagcagcttaataatagaaattgcctcagggatggcgtctgccattgcttttcaaatgcaatactgttctccctccggggattgtgctgcagaggctcctggagtgaatattgcaaaagccactaataatactccttctcaggtaacattttctggtataaaatatcttggcttaatatagtctaaaaacattgaagtgtaatgtggccaacacgataactttctgaaatacaatactattgtccttacttctgtcttggtttctgtggtgtcagaggcccaaaatgaatcaagatgacaaatccttagctaaggcaatgtagaagccaccatggtactgtacaggaattatagtctcttatttttcccgggagagaaagcatggagtaatgtaaagaacactggatgagtgtcaggattcagcttcaggaggggaaagccaatagacttgggcccagcacttaaccactgtgcgccttatctcttaattggaaggaattgggctacagggtcttaggggtccttctaaataagaagttttcaattctaaggtttcttctgtctggagaggagcatatcatgatggattggtctctggaatcaacaggcttggttttgaactaagagatcttcgaccagttgcttacccacccgtggcctcatttttcttatataaaagatggggatagtgatattacttgtatcagtttggatatgcagctgctgttgatttgttgattcagctgctccacaggaacccacgctctttttgatgacttcaccatctttaatttcatcttcatgtttgttgcctcatcttataaaaaggcaccagcctctccaggtattaagtcttcattcccatcagaaagcagggggtgggagtgggaggtgatagcaggattttttttcaagtatatgcatggggaaagggtctatgttctagggctgcttcttccttttctctgaaaaggaacaactt

SEQ ID NO: 14501 - DNA, 1093 bp, Homo sapiens
ccctgtgattgtccatagtaaaaccacacagggtgtatttgggggtggccttttttgttgtgggggtgattctgtgagtgttgctgtagctcaccctaaattactcatgtccatcctaaagcacagcggaagagatgtacatgactgtcagaccagagcttctgccaagcagaggcaggatgcaacaagacacttgaaagcagaaatcttcctgtttctgtaacatttccagctggaaaaccaatcagagccacacattccagctacacttgggaaacactgaaatatccaagtagtaatcacctaggtatgctgctaactgcagctcaaaataattctggggttgccagtgccatgtaccttgtaggcttccaattacctgtgctcacttctctcttttctccaaggaccaattattgggggaatttggcatttctcctcctctctgcttcagccattcaaagaaagattgttatacaccagaatgtctgaccattttaattaagccagtcaaaggtaggtgctgaaacagtttagcccccgaagcaaggattaaacacttaaggttgaggaacatagaggttagttagtgtcaaagagttggaagagaccctagagtaggatgaccatacatttcagtttaacctgaaagcccctgtctcggtgtaattattatcacttcttttctctcaaaagtgctcagttgggacaaaaatgatatagctactttgccttaaagattatctagtctgcctttcagtttggttcaaatttaatgtagaaattatctttctgtgaatgatggagacttgggagatgtaaaaaaataaaaaaaagcttttattttatttaaaccttaaataaacctatttatttttattaaaatctttctgttttctcttcctttcaaacacatggtcatctgtttgctattaaccaccagtaatgggggactcatactttgcaaggaatctctaattaatgagttctcagttctgcatcaaaatcttccttcctctggcttcaccctttgattctagttccttcttctgaaacaatctagagtaaatttcttctctcttccacaaaatat

SEQ ID NO: 14502 - DNA, 1103 bp, Homo sapiens
tcctcctcatccaccctgcttcatgctgttccataattgcacgttaaaatgctgtaatgaacagatgcttctagtgtgtagtctctttgtaatttctgctatcatcctccattttcatgcaaaattaatgtatttccagatgctgattcctgagtctttctacccgatagtggcagtgcatgagatttgaaactgggcaagggggtatgaagatgtgtttggggcagaggtaaaagagtaaagaggtcttgcctattaaaaaaaatgtaagaatgcagcaaacaccttgtagtgcctgtttgttttatcatgaatatgcagttctgtgctaccctgtatttatgtggttgggaggagagactgcagatgcaggggaaatcttcattccattcttatcattcagactctaaagtggcttgtcattgaaaatttgggctttgaaaattcaaggctgtcataatttaggctatggagcaagatttcttgtccaagcaggagtcttgctggtcagtgggctggggagtgatttgtgtgaatttatctcagcacgagtcccctgaggctggtttctaggctgccttggttaaaaatagcctgttgatgaaatcacatcctagctcaaacctagcccaaggaaatggctcaaggcccgagcaccttactggaatatgaagcagagacagattcaccaagaagtcatcagattgtccctttactacaatttgcactgcagtgaaaaatctgtgtcaacctctccctcctctttcaaaaattagctggttagattctcacaggactgcgttatttgactccagtcagggtaatttggacaaatcttactgagccctgaattgatggtctagagtgaattgagtcaggattaaagtcaggattctctgagtctgacgaccagaggccaagactcttcctttgggaagctgccaagacatctaagagacaggctggagatcatgttgagagcaccaaggccaggaaggactgctgatgaagttttgtccttctgttcagtatttaacgtacttcctatttgtaagacattccttaaaaattgctacaggcacagtttttgttaattggcttat

SEQ ID NO: 14503 - DNA, 1142 bp, Homo sapiens
ccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcattatgtgtgtgggtcttcatttgaataagacacaatttgaggcattgtaaacgtgtgccttttctcgtttatccaaagaaggatcatttcagatattccgaacgtgttttatttcacc

SEQ ID NO: 14504 - DNA, 1110 bp, Homo sapiens
cctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcat

SEQ ID NO: 14505 - DNA, 1164 bp, Homo sapiens
agtgaaactccatctcaaaaaaaaaaaaaaaaaaattaaaaattgactcacagttccgcatggctggggaggccaccaggaaacttgcaatcatggcagaaggggaagcaggcacgtcttacatggttgcaggcaagagagagtgtgtgcgcacgtgtgtgaaggaggaacagtcaaacattatgaaaccatcagatcttgtgataatgggacccccccaccctgacccatgatcgaatcacctctcaccaggtccctccctctacatgtaggaattgtggggattacagttcaagatgagatttgggtggggatgtagccaaaccatatcagtgaaataaaaatggtataaatgaggctacaaagtacaatattactatttggtaaggtttatatagatactcttaaatataaagtatatggatactttatagtacaatatggccttattaagtctaaaagtgtactttaaaactcaagtgttaatgattatttattctattttagctgtggcactttaccttgctgatcagtggtgggctattgatgatattgtgaaaacatctgttccttcaagagaggggcttaagcaggtaacaagatcctctaattttgagtgtttcttttgaggccatttcacagtgtttcctgtaaacagtgatagtttttgagctcttccccatttaaaaataatcaggttatattaaaccctagaatttcattcttacgatgaagccagcattcgggttgggcttcctccatttttatgtgattctataagtatctgagattgggtgaggaagaatgaatacctatgggttagttgagctttggctacctttatccaagttagcttctgattttcttatttgatagaggaaaagctagttccctttgtgtgattgtttagcttctgtctctaggagagactgaccaggaaacttgtttattagtagggcctcttcaggtggtctatatagtgttcctaacagtggaatgaccaggttcaggagagagcaagcttccaacctcggcagggttatagtagaaggcagccagctgaagaacgttgcaggaaggaagctggttttcatgctagagatgaaagggtttaagagacatctctggtgctctagttattggaggataaataggacaggatat

SEQ ID NO: 14506 - DNA, 1107 bp, Homo sapiens
tttgaaatttatagggttgtgcagctatcatcacaatccaattgtagaacattttcattattccaacaagttctcgtgtccttttacagtgacttttatgttgagtggtttatgagagtatatttatatgtgtatttttgtgtgtatgtacatataaatatgtcttatgcctatgtgaccatatttattatgtaaggacgtatctgttaatttatttcattgcctgtttttaatacaaatgaataatgtttgaaagttttctttttgacatgcatggttaaatcagcaggttcaagttgtattctgcgggcaaagtgaaacagaaaaatcttgttataacaaaatatggcaacattgtagtaaaatttattttctgtgagtaaaggaagatggcgtttcatattctgaattgtttgttccatgttgtttgttaaagaggatggcattccctgtggatatgctggaaaattgcagccatgaggaattggaaaattctgctgaagattacatgtcagatttaaggtgtggggaccctgaaaatccagagtgtttttctcttctcaatattacggtaaggtgttctgcagtgattgtcatcaatcttttcagttcagtttatacatgaaataaatatccttttttaaaaaaatcattttaagtgttaatcattaatttttgaaatctttacagaaatctattcagtaaaatggataaatattggttgatcagtttttaaaaagagaaactccacaggttattgctatttgactttatggctttaaaattatatgtgagaataccaccagttttgctaagactgtttactatatttgagctgcttcagatttactttagatttggaatttgtgagtttagaaaattttttaattaaaaaatcagcaaaacactaaattacatattttttgtgccatgaatcttttcttcctttttctaaaaaagtaaaatcaaattttctagtcagtaaattataatattttgtgatagatcattagacttggaaccattagggtttcactgtgaactgtggtggacaaattccttaacctctctaggccttagatttttcttctggaggtgacttaaaga

SEQ ID NO: 14507 - DNA, 1210 bp, Homo sapiens
ttataggccgtcctaacccatacataattaaatgtttttactttcccagaaaacagaaaaggattgctgaacagtgttgaggcccatctgagattttgatagttgtagcagttattttgtcatattcaaaaactcggctctcatagtagaaaaagatgagtggttagaggaatctagcgtttaggaccttgtgtagggcaggagtgatggaagaaaaagtaaggtaaagggattagttgagctgatgtagtacagggcccaggttaattagggaaggaaatgatgttagaaaacagaaaagggagggatcaagagaggaatcataataaggttcagaaataaggttgagagcattgctgattatgttgcctggatacctaacctattctcggtgttggagagaccattgtgagagttaggatcatgaattggattggttgagataattatttttttccctgagaattctttcagctctatagtgtacatacttctttttgggtctgcctctctccacaaagcccccaaataatagcagtaacctgtaagaatcatgaaataacttacgagctgaacatgtagaatatgttcccatcttttcagaatatagttggcatccagtaatcaacaataaatagggaaaaaatcacaataatataaatttgttttctaactcttttcatgcttttcttaaggttatccattctgtcaaatacataatttttttgggaaaaaggaattattaaaaggtagatacaatatagcagatgctcatgatcttagatctcttatataagaggtcttggtattatgtttttatacagcttaccctggattaatgagcataccattcgcttaatttgtaaattagtttggacactttttacacttcgctgtccattctgtgtcagttttttgatgagttcacttaaggctacattaagctttctcattcatgtagaatctagttaggccttttggtttatctcatggacagagcataaagtacttgacagaatttgatctgacagctttacagttacataacatagaacagaagcttaaaaacaacaaaaaagagagagaagcaagggatttatcatagcaacctatatttctctctggaactttaccacccttccgctgcctctctaaactatagtagcagaaccactgttaggcttgcaatttacatagtcttaaattaacc

SEQ ID NO: 14508 - DNA, 1149 bp, Homo sapiens
gtagtctcttgaatttccacatttgagggtaatcgtggaattaaaaaaatacaatatatgcttgttctagtcagtcaaatgatatcttaaaatttaggtaataaaatacaactttgagtttttgtgagcagtttttataggacaatttaaatttatgtttcaaagcattgggaattaaaaaaatacaatatatgcttgttctagtcagtcaaattatatcttaaaatgtaggtaataaaataaaactttgagtttttgtgagcagtttttataggacaattcaaatttgtgtttcaaagcattgttatgtttgagcgacatcagaaatatgttttatattatactcaagtttatttgtaaagtgagggagaaggatttggtggtcatctaaggtctcttctagcctctataattctgttttctatttgagatcaccaaatgataccttaaacagttgtagtacaatatgtttgttaatttttagtcttaagttggcattttgtattatatcattttccaaacagatcaatgaaataaccaaaattataagaacttcagtaggcatcatagaggttatattgaaattagagtttgttggtacacaaaaaatattattttgaccttatatcaggactggcataactggcaggatattctacttatataaaaaatccttggttaattggcaaattgcttttctcctaacaagtgggattagatcaatagtgtcactggggttttgctctgttagagtagcctgtcctctccttatttaataataaggcactactgcttgacaaaaaggaattggaaacacatatgttttatcaattgtgtattaaacactaccattctgcctggcattgtgatatggggacatgagagaaggcaagagctttgctcttgagggacttagagttctgttgttattcctgctgtttcctaaggcttggcatcacctctaagttgctaattctatttccagtaagtggcaaggagcttaatgtactaatattttcatgttttgtccacctgcaggaagacaaatatatccttgtgatatatgcagcataaaaaataacgtagactttactagttgtatctttaatttttctctaaccaggggtacgtcagcttgaaattatgtgc

SEQ ID NO: 14509 - DNA, 2443 bp, Homo sapiens
tcatgattttaagggtgaatcttgttgtgtctctccctggctacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtaagactcaaagatatatttaacatgttccccctatacttcaaaaaatatgcagtgtaaaaacttactattcatctactgtagttccaagttaaaattctacactcctgatatttatatattgctactttgtcattttctaccataggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataagtgtaagcagtaaccttttttctttggattaaccctagccctgaggtctggaagcttgtaaagtctggtcatagtagtaacctgtaattcatgctaggactcacatgaccatttattctcaaattctacaacattgattgatagcagtattctattacattaaaatgagctctcttagagggtttgattagttcagatttatcatctcaactagacatcttttggatagtgagagtgggagggctagttaaggagaagaggggcagccacaaccaaa

SEQ ID NO: 14510 - DNA, 1931 bp, Homo sapiens
ttacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaatatgctggcttgatttgttttccttaaccctgagatattgccctactctgaatagttaagagcttgaaattcagtgttcttcccgtaacccagttagggatcaagaaaactactgagttgcagcctaaatttttttttttttttttttttttggagacagagtcttgctttgtcacccaggctggagtgcagtggtgggatcttggctcactgcaacctccacttcccaggttcaagtgattcttgtgcctcagcctcctgagtggctgggattacaggcatgaggcactatgcccggctaatttttgtatttttagtagagacagggtttcgccatgttgg

SEQ ID NO: 14511 - DNA, 1238 bp, Homo sapiens
atgccattgcactccagcctgggtgacagagtgagactccatctacaaaaaaaaaaaaaagaacaactcttagaggcaagctaaggtgtcttctgcatagaaggcacccttatagtcctgttcagcccttctggtcctcttacagagtggaaatggccccacggaagggagcaagagataggaagactacagggtgaaataattcataactcagtaaccttcccttacacaaatgagagtgaatatggtttaaaaataatgtatctaaagacattccacatatttgggtggcaaaaataaatagatggctgatactgtaatcatctcggggagctttaaaaagaaataattgtatcatacccttctccatagtctcactaaatgagaatattcaggggttgaggggagagagagagattaagattttgttctttaaaagttccttgataggtagatatttattgagcataccttgattaccagtgaaaatacaaagatgagtaagacttcatactcagaatcagaatccagagtaaaatgactcagttgaacataagaatagacattaatttctatttcttttcatcctaatttccttaaatatattttatttagtggtagaagatgatgaagatgactttcctacaacgcgttctgatggtgacttcttgcatagtaccaacggcaataaagaaaagtgtaagtaatacatttttcccctcagctggataaaatatactttcagaagttatgtaacaactcacaagaaataattacctgattaattttttaaaaagcagtagaactggtggaatccaagtgaaaatatcttccaaggcatgcaggtaaaaatcacattctgacattatgtaataatggtaacttttacataaggatgtccagctgtcccagcatcatttgctgaaaagacaatttttttcccttgtcttggcaccttcgtgaaaatctgatagactgtaaatgcgagggtttatttctggattctcagttctgttgagttgatgtacgtgcgtattcttattaagaaaatataagctttaaaaaagctttattgagatacaattgacataccatttaaagtgtataatttgataaatttggatattttcgtgaaactatcaacacaatcaagatagttaacatttatatcaccttcaaaagttttctccatcccctttgtcattcctctctcccccattcctgaatagccactgatc

SEQ ID NO: 14512 - DNA, 1387 bp, Homo sapiens
tgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaat

SEQ ID NO: 14513 - DNA, 1642 bp, Homo sapiens
gtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctg

SEQ ID NO: 14514 - DNA, 1330 bp, Homo sapiens
aaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataa

SEQ ID NO: 14515 - DNA, 1563 bp, Homo sapiens
agctccatcagctttacatttcatgatcattctttccagattctggcaaagattggatgttaaaattcatttttgaggttgttttgagttcccttacttccttatgtctataggtattttagtgctaagttcaaagaggtggcctccagggacttaaaggcaaataccacttgcaactggaatcaaatatatgtattgtaaatgtaaaccataatctaacctgtgttaactatctcgttaataattttacttatttaaaaacaaagctaattaggaaattagaaatacttgtaattgcagtgagtaacaatcaccaccagagtgaatgggcaccttctctgttcttattcagttctcagaactaacttatgtggcactgttctttcactcttagagcccagaaactgtaggccaaagaggtgaaataccttgttcaaagaccactgtaaccaactggaggagctgggatttgaaccctggtagcttccctctagaggccccatttttaaccagtataccataggcctggtcttttggttgttttggggggattgttttggctttgttttagacagggtctcactctgttgcccagctggagtgcagtggtgcaatcatggttcactgcagcttctacctcccaggctcaagtgatcttttcatctcagcctcctgagtagtggagaccacaggcatgtgctactgtgcctggctaatttttttgtattttttgtagaggcagagttttgccatgttgccctggctggtcttgaacacctgggcttaagtagtccactgcctcagcctcccaaagagctgggattacaggcatgagccactgcgcctggccactaggcttgtttttaatagtctctatggatgatgatttatttcaagatgccctttttgttgtgtttcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtaccttctctaatttaatatgcttagtaaatgttcactttacatcttaaaacgaatatcatttatagatatctttagtttatttcaaatatttttaaaatatgcgttgatgtttttaagcagtgtatacagatgtctgtggtgaaagctatagctccttcctgtagatttctctctcctcttctacttttccacatttgagttgtactaaatttagaggtgtgagctgggctcccctgataacttcagggtattccccccaccctgtgtattgctcataaaaaacattaaaattcacacagttcgcattacacagatacggtttggatttaaactagctattttaatcttcattattctctcccaaaatgaacatcggaaatgtgtgaaatataaattttttcctgcctgacacagatgggtagatcccatagcaggcttcccagtcatgg

SEQ ID NO: 14516 - DNA, 1212 bp, Homo sapiens
aaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgca

SEQ ID NO: 14517 - DNA, 1176 bp, Homo sapiens
aaatgaaagatgtattttgtttcctttagtgtagggtatgtaatacccattagcaagcaggcaattcatttgtttaattcaaagattatatttaactctgttgtgacatcagaagccttctttgtcattgtgaatagtcagtggattattttggcctgaatgctgtcatatatgtaacatgttagtaaatcttcctttttacttttctcttttgtatgatgatgatgggtcaacaaaatgagaataaactttttctgaggtttttatttaattaatgctggtagctttagaagactgttattcacttattttatgagaatatatacagtgaaacaaaaccaccagttatttcttcctttccttgtaaagaaggaacagaatgtgggaaacctgtggaattacaatatatttagatgaggcttgggattttttacttttaattttttagttattaacattaatggtttgtaatatttgagtaaataacaaagtactgaaacttgaaaaggataaacttaatttttattgtatttcattttaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttacaaaatttttaaattaaccttttatcattaaaccacatagactttatgacagagaactataatctgttaggttctattcgaagtctacatattttgcttcacaagcatggattgagttttaaaaaatagaataccattttttcaaataacaatccaaattttagttgggtgtagtggtacatatctgtattcccaactactggggaggctgaggtgggaggattgcttgagcccagtagtatgaggatgcagtaaggtatgattatgccaatgtactccagcctacggaacatagcaagaccctatctctaaaagattgaattgtaagcagtttatttggaatagaatacaactgata

SEQ ID NO: 14518 - DNA, 1106 bp, Homo sapiens
atggagggccagactcctcatactcctgcttgctgatccacatctgctggaaggtggacagcgaggccaggatggagcctccaatccacacagagtacttgcgctcaggaggagcaatgatcttgatcttcgtcctgctgggcgccagggcggtaatctccttctgcatcctgtcagcaatgccagggtacatagtggtgccaccagacagcactgtgctggtgtacaggtctttgcggatgtccaagtcacacttcatgatggagttgaaggtagtttcgtggatgccacaggactccatgcccaggaaggaaggctggaagagcgcctcggggcagcagaaccactcgttgccaatggtgatgacctggctgttgggcagctggtagctcttctccagggaggagctggaagccgcggtagccatctcctgctcgaagtccaggacgaggtagcacagcttctccttgatgttacgcatgatttcccgctccgcgtggtgatgaagctgtagcggcgctcggtgaggatcttcatgaggtagtcaggtcccggccagccaggtccagaagcaggatggcgttggggagggcatacccctcgtagatgggcacagtgtgggtgaccccatcactggagtccaacacgatgccagtggtacggccagaggcgtacagggacagcatagtctggatggccaagtacatggctggggtgttgaaggtctcaaatatgatctgggtcatcttcttgcagttggccctggggttcaggggggcctcaaacagcagcatgggttgctcctcgggagccacgcgcagctcattgtagaaggtgtggtgccagatcttctccatgtcgtcccagttggtgacaatgccgtgctcaatggggtacttcagggtgaggatgcctctcttgctctgggcctcgtcgcccacataggaatccttctgacccatgcccaccatcacgccctggtgcctggggtgcccaacgatggaggggaagactgcccgggcggcattgtcgcccgtgaagctggccttgcacatgccggagccgttgtcaatgacgagcgcggtgatatcatcatccatggtgag

SEQ ID NO: 14519 - DNA, 1257 bp, Homo sapiens
ctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggtagttttgatctattagtagatatctgattatgtggcctgctgaataaattctttgaatctcatttttccttatgcccaactttggaaactaactagcataaacttatagaaatgtttaaaactagttatatgatcaacctattagcatcttttcctagagtatttgttttatttgctaccttaagttactgttttcaaggttgttctataatcagagaacttttctaatactttcgtacctttttaaaaccagctgaaattttacttcctttttgaagcaaggtaa

SEQ ID NO: 14520 - DNA, 1182 bp, Homo sapiens
attaccagaaagtttaaaatgttattgaaaataaagagagttacaaatcgacagtaaatacaacccagagtaagaagtattttttaaaaatgacagaacaagaaatcagtgagtgtcaagtggtagaagttattcttaggaaattttgtaacagttgaaaaattatagacttcagtgcctctgtagtattagaagcagagctttaggatcccattaaaaagccacagtggttgaacatcatgttgtgttgtaccccttcctccccctgaaaaaaacaaaagaagataaaaaccacaggggcactccaggtcagtgattctgtttgtttcttctttgtcaaagactttcagtgatcagattaaatctcttgatagttaaaaatattttcctatagaacgtcagtataaaaaacctcaaactattgcagtgaaccaaggcctttgagaaattcgggtttcgctcacattgttgatagttttgtgttcatgtgtttcccttaggtggcttattttctttatattagaatgccttttcccatctataataggcatacaggactgtggagttttttgctttagtttagcaactggaataagtactctccaccttggagctaccataactacttatttatttctgtttctttctgaatgatttggtgtataccatgcaattacagaatatacctattttctaataataggtgactataattgtggaaaagtcctccttgcaccaagtgttgtggcttctgccctaaattatgagtaatgaaggcagatggtgggtactttactttaatttagcatgacaatatgttagtgctgaaaattcatatgccttatatctgcagcctaactaaatctatatttttactctttcttttcttttttttcatccagacaatgtgttttgagggcactgagcatgaaaatgcgacctaggagttaccttgaatatatggctttcaaaacagttaatttttatggtagtcctatgagataagcatagtgttctacttgttgggagagaatatctttgtttcagtttcctcatctgtaaagcagacatgctagtacctaccttacttctttcaagtgttatgttaaaaataaaatatgaaagatcaatgtaacacactatgtaactataaaacaacagttttaacatttttaaaaattc

SEQ ID NO: 14521 - DNA, 1152 bp, Homo sapiens
cagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttg

SEQ ID NO: 14522 - DNA, 1215 bp, Homo sapiens
ctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctccccgtaataggcggtggagttgctctgtgaggatgttcatggtagacactaagagggctgggtgggagatgcttggctctgtggcatctgttcagcgaggcttttcctatattgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagaaatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctccc

SEQ ID NO: 14523 - DNA, 1324 bp, Homo sapiens
catttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgca

SEQ ID NO: 14524 - DNA, 1190 bp, Homo sapiens
aacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaacctgattttgtttgtttaaaatatcagtggtacatattttcacttcatttcaaataggaggaccatagcaagttgtatatctgttatgacaaaagttataacatggagaacaggatccagagaccatccatgcctgtatttctgcctcttcctgagcgctgtttgttgtgacatattttgatggcaactttctttgtgctattaatgaactttctcattgtttataaatattcacaaagtttggaagtgctgacttccaaattggaaaatttttaaatgggggtggggagaggcagaaaaatatttataaagttacacactcagatcaaatagatcaaaatctcaaaaatagaacagaaaagaaaag

SEQ ID NO: 14525 - DNA, 1198 bp, Homo sapiens
cagcctggccaacatggtgaaaccctgcctctactgaaaaatacaaaaattagctgggcatggtagtgggcccctgtaatcccagctactcgggaggtcgaagcaggaggatcgcttgagcccgggaggcagaggttgcagtgagccaagatcatgccaccgcactccagcctgggcggcacagtgagacttcatctcaaaagaaaaaaaaattataaaaaataatatggtttataaatcaggcagctatgtaaatcacaatccctgttgagaggctgcattatggcagtagcggtgggaatggattcagagtctataggtggtagaaccggtaggacttcttgactaatttagatggcaaggaaaagaggaatgcaggatgcttctagatctcgtggacaaccagatgaataatctcatttccccagagagtgaattcagaagggcagaaactcagttttgtgagttctgttttgcattttacatgcctatcgaatatccaagtggaactgtgggtctagatggagctcgagagataactatgagctggagataaatatttgggagttgccactttatgtagtggtaattgagagcataagaaatggagagaatgcagggtgaaaatgtcatcttggggcagatgcaggacaagagcttgtgaaaggaatggccaagaggaataggtggacaaccagaggagtgggagctcacaggagccttgagtggagtttcagaaacccagatttcacacagaaacatcaacaaatcaacttcgcgtctcgaggtgatggtatttaaactgtgttctattgagacccttcattaatatttggttttgaaatatattttaacataagttaaaaatagcaaactcaaatatggtgtttctaacattttaaaactgaaatccagcaaacatcagtgccacgttaactgtttttttgtgcaggtgccagaataaggccatttctggtaaattgaagagcttcctggtatttcaaggtgagctgttgaaagaactggtaccatttctcagtgtgaatcagggctttctcaatgctctgtcactgaaacaaaatacagaaatagggtctacataagataacttctgtcttctgtaaacctagtctcaaatgtttgtttatgaaaataattttattttgaatgacttaactgcttaagtgtgacatcccat

SEQ ID NO: 14526 - DNA, 1134 bp, Homo sapiens
aatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagctgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaa

SEQ ID NO: 14527 - DNA, 1119 bp, Homo sapiens
acaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaacatgatgttttgaaatatgtatatattcaggaatagccaaatcatgctaattagcatatgcattacctcatgtttttgtgctgagaacatttaaaatctactcacagtaattttttttttctgtttttttggagacagagtcttgctctgtcacccaggctggggtacagtggcgcgatctcggctcactgcaaccaccgcctcccaggctcaagcgattctcttgcctcaacctcccgagtagctgggattacaggcatgtgctatcatgcccaggtaatttttgtatttttagtagagatggggttttgccatgttggccaggctggtcttgaactcctgactacaggtgatctgccca

SEQ ID NO: 14528 - DNA, 1198 bp, Homo sapiens
ccagatatattgttgtaggactttttccttagttcagttaaagacagcgaggttgggggagggtggtcctcatcacacagccatgtaaaattaggcccgcagacaattcgaaggaggagaaaaatggaatttattgggcaaagagcaataaaaagggaaacaaagactctccaacaagacagaacgagaatcttgctagtatgcttcccgcctcacagactgtaatcccaggttccacccaggaggaggaggggccaggctcctccctgctgccaaaggcgtgaacttctgtgtctccaccccagtgcaccctcctctcaatgcatacgcccattggagttttgtcagggagtccttcccacatgactatctcagtatgaaggaggagtttcctttgtgcctaataagtggctgtgtcacattcctgggcattagagtgggaaatgtctatattctgaattcctaacatatctgattattgctattactcttttctcacagggaaataaatgcccggcttgatgctgtatcggaagttctccattcagaatctagtgtgtttggtcagatagaaaatcatctacgtaaattgcccgacatagagaggggactctgtagcatttatcacaaaaaagtaagtgtgatagaaatctattaaagctgacagtgttcttcagcttgaggacactatatattaaaagaaaacttttgagagctctattattattttattttgtaaaatcttacaaatagcatgcgagagtagctgaatcctcagaaattttaatagtacaaattagagttattccaatttttccattgtagaaaataaagttttctcatgtgccttaactacagcaacatagaggcccttctgttataatatagggtattctcctgtttcatcctgaaagtacagactattatcaaaataggaaatttatgtagacttgttattttagaaaaaaaaaaccttatttcttttgatcttagaacaacttattgtttcttaaactatggaaaaatctgctagtataacatctgtggtggtagttagtatgcaaacaagcttggatattgaaggtgagtaaaggattattttgatttttatcacttaagctttacagtttgagtcatagcaaaaatgagtcattttccacggttagggaaataatttaggttatcttcaaaatatgcc

SEQ ID NO: 14529 - DNA, 1205 bp, Homo sapiens
ttagttatgatccagccttggactaaatttaccaaaggtttttacaagtgcctgcaaaacataaatctgtctggatggagggaggcagagggactgggtaatgatgagcctctgggtgcagggagaggataggacttgatgctttccaggggaaatatttaaaatttcagtactaagttaagtctgtatcattttactttttttatagtttcttattttatgttgtatgagatgaaaagcttgcacataaaagatgataagaaattagaattcatcgtttctgttgtaccaagaagaaccttagtgatctctaaaagaattgttgttaaaatatggattcttctttccttctagtactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacaga

SEQ ID NO: 14530 - DNA, 1276 bp, Homo sapiens
ttttggacagcacaaagaacagttctatcattgcaaatgattttattgaacaataacattcttacttgtccgcttctccatgtctgccacatcaaaagtgggaactcatttcctagtaacttcttactcctcagttttgctaacttctcattggccccactgattctgtctttcctcatatggcaaaagatagtgataccagaaaataatatattattttggtgatcattagttgctggttcatacaagatttcctttcttaaaacagttctgcagtactattgaccttgctctccttaccttttcctgcaagtataacaattaccaactaaattctatataatccctacgtgacagcctgtcacatttgggctcttgttgaacttgatagcatctgtagctcttgtgtcttaaaattgtgtgttactgttaagcaagagctcctgtttttgtgtagttggatattttttagcctacatttaggtttttatttttattcatgataggtatcatctcatttttgcttgtgactttttaaaaaattaaatcttaaattgtttacctcacaatcattattattattattatcatcatcgttttatacccagctttgataaacaacattcctttgtaggttggtcaaaactaacttcttattttatttttattttttgagagaattaccagatgggcagcatgctatagaagtggtgagtttgatctcaaccaaatcatttagaatgctttcagaggtgggcagtcatgtgagtaaggactccagaaatcatatcaaatttgaagaacctgacaatattgaatgtggagaaaaatagactattttagatattcgaaggactgtgttgaatgagcagtgttgatcagaaggaaaatttattatattgggagcaaatttatcaaggttaattataaaaaaaaatgtgttgctagtgtatccagagcaacacacataggttatcaagaccttggagcaacaccagataagaagggtaactgtaggatgtttccattcttggggccacagaggtgaagtgagccaaaaaaacacagtgggaattaaacaaagtagggttaagttttcattaaaggctgtgcctgcattcaccactcctggttgccctggcaacggggctcccttgcatgctaatgacattataatgtgaaaaaacacatgcaaatgcagtaaatagtaattagagtcagaggcatacatggagtagtgagctccaccttgggaaggtctgcgaagagctggtga

SEQ ID NO: 14531 - DNA, 1235 bp, Homo sapiens
ttacctggccagccctggctttaataggactgataccatggaatatttcatctcaccaagatgtgacatggattatttttcccttggacacaaatgtctacagcaactggtgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcggggaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataa

SEQ ID NO: 14532 - DNA, 1227 bp, Homo sapiens
ttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacat

SEQ ID NO: 14533 - DNA, 1177 bp, Homo sapiens
atgtattcataattataacgaagctaagtcaccattatcttttctgctttaaagtatcagaagctgctaccttgccatgaaaaagtattacatgctcctccaattccttccccaccatatttatccaacaggaaaggaatgaataataaaactttgggctttttttcccttcttttttttccaggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaatacatgccttctaatcattaattctgtagtatcatattgacgtacaatatgtgttctttgcaacctataacagagtatctttagttaggtttactaattaacatttttttttaaataacatttctcaacattcatgatataattattttaatttt

SEQ ID NO: 14534 - DNA, 1142 bp, Homo sapiens
tcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttc

SEQ ID NO: 14535 - DNA, 1056 bp, Homo sapiens
catagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacactgtgactggtctggttatttacaactttaaatccttatgtgcaccaacatttttacattctggttccatcatggagagcaagcttctaacctggatgaaatgattttgtggcaagcaaagaaatgattatatatttacccgtaaaagttgcgataataattctgataatgttttcatctgaatactatgtattaatttcaaatatggaaactatgcaatgggaaaagtgatagctcacatcacaga

SEQ ID NO: 14536 - DNA, 1204 bp, Homo sapiens
atatctgaacaatgtacttatttaagacttttcccgttgtgtcaaataaaatgttggtattttaaaattatttttcttctaaggtaataaagttttagaagacacaaaactgaattttgtaaaaaagaagtagaccttacaatgtagataaaatgtcctgcaattatttggttatattttagaaaatgtgctgctattttgttttaaaatatgcattattatagtgatagtaactgtgtaggaattgttcagatttatagtgtgtgacttagaatggaggatttaagtacaagaatttaggtgacggctttttaagcactaaagcacttttgaatgtggttgttactatggagaaagaagattgacttagctttgccttttatcttttccaaaacaggtttgtatcaaaatgattgatctcttaaaataatttaatatgatataatatttcataaatgggaagaccaaggttttaatctcttgttagatgatatatgcttgatttgaagatgataatctctaaatggggttaggccaccatgcattccttaaggtttgtgcttggtatttaacaaagtggtatattttgggaatgcaaaataatcctttaaatcccctcttgtattttaggtcaggggaaccatttagattttactgattctggggattatttgaggtcagccaggatgaaatgggctcatgacacaatcaggaaagtccaaaacaattgagtggaaacattggagaatattttttatttgaaataaatggacagatccctctctgtaatgtagagcagtctcccacctacaggcctgagccttaggtctgtgctcacatctctgcttcactctttttttttttttttttttgagacggagtctcgctacccaggctgcagtgcagtggcgcgatctcaactcactgcaagctccgcctcccgggttcacaccattctcctgcctcagcctcctgaatagctgggactacaggctcggctaatttttctgtatttttagtagagacggggtttcaccgtgttagccagggtggtctcaatctcctgacctcgtgatccacccgccttggcctcccaaagtgctgggattacaggcgtgagccaccgcgcccggcctctgctgcactctttatcacattttctttccaaatactatatgaactttaattttaactatgctatttt

SEQ ID NO: 14537 - DNA, 1223 bp, Homo sapiens
caaagcaatgatggaaagaacatctgtgttcaccagaacgtactttcttcctttggctgtgaataaattggataggactattttattctaagttctggctattgggagatatggggataagattgacattgctgtcgcagtattgcaaaaacatgactaatttggttaattatgtctaccatttatgtttaagagatcctttcactaacttaaattgttaacttttaatttcactaacttaagttgttgtgatattgagaaagaattttaacctaaacagtcactttacaacaatcatgtaaagacgagtgtgcctgcagttgaggtttttttgcatttctgagcccactttgtattcatgagaaacaaaaacataatgggagaaaagttttaaataaccagtattgtaagttttcataaagtttgggacttcaaagtattaacgaaggatactgaaaacatactggacttttactttggtcaaattactttctatgatctgatttcttaattttctgtatttgaagtcttgccaattaggaatatctatatctatatataaacagataactaaaacttaatggtaaaaataagtgtaattcagtaaaatgattcaacagtttttatttttagaataagttatcgcttattgcattgatatcatatttatatattgccttgcaatgctaaatgctctaaaaagaatatttaggctacttccattctatgaccttcttccccctcccccaggatatacaaaagatcttatattaactaattctctatgtgaattttgccatatcaaacattgtgccttattttattaaaactgttttgttggaatccaattctgtattaaagtctctataatgttaaaaaaaaaaaaagaaaagaaaaacatctcatgctcatagattggaagaatccatatcattaaaataaccatattgcccggagaaatctacaaattcaacacaatttctatcaaatcacctatgtcagcgtcacataattagaaaaaaacaattctaaaattcatatggaaccaaaaaagagcccaaatagccaaagccattctaacaacaacaagaaaaacaaagccagaggcatcacattacctgactcaaaaaaagttactataaaaagttatactaattaaatcagcatggtactggtacaaaaatagacacacagatcaatggaacagaatagagaaccccaaa

SEQ ID NO: 14538 - DNA, 1099 bp, Homo sapiens
aaaaaaattagccggacgtggtggtgtgtgcctctaatcccagctactcgggaggctgaggcaggagaatcgcttgaacccgggaggtggaggttgcagtgagccgagatcgggccactgcactccagcctggacagagcgggactccgtctcaaaaaaaaaaaaaaagaaaaaaaaagagctgtattgcacttaacattgccatgtatcttctaaggtgactacttaggacagtagttttttcgattttctaaagtaagaaacttctcactatttgacgtttgagtcctcaagaccattcattgcctagtgcttagtaaagccagattatttcttgccatgtagtgttttgtgatgaaggtcataggatttgaaagataaatgtttaaaacgatgttatgatttatggcatatgttaacctgatgatgtaaaatataactagcatttcctgtatacttgtattttgattattaagcagatgatttgagattcaatttcgattactttttctctttttttccaacagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgtt

SEQ ID NO: 14539 - DNA, 1240 bp, Homo sapiens
gtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcgatcttaggtttatttctatgatttttttttttatcgttaacttggaaaaaatacttttgctcttgccctttgacatagtaaattttttttcccatgattgattaatcatcaagaaaacttaatttattcaaattgaagttgtggttaatcagatatttaggagcttcatttttgttttttttcctctaggtctgtaacctaaaacagaagtgtttgcctcagtaagtgttttggtgaccagtattggtcttatttagaatgaataaaagaatatttgaaattgaatataataccatgaaatttgtagtat

SEQ ID NO: 14540 - DNA, 1240 bp, Homo sapiens; identical to SEQ ID NO: 14539

SEQ ID NO: 14541 - DNA, 1152 bp, Homo sapiens
taatagagacttatgttttgaggggaattgtggtaatattttatgcatccttttgctttgatacagtttttttcaaatccaggttcccatcctgaaattgctgaccgagctttcatttattttcataccatttttcctctgtctagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgtt

SEQ ID NO: 14542 - DNA, 1105 bp, Homo sapiens
aacctacttttcttcccatacttacatggtacatatgtgggtactgctttatttttaactcttccatctacattatacaaagtactcttattcctcagttaatttgtttttccagatatttaggttgtactgcataacactgtcattgagtcagtgatgtttgaatgccatggcaatattggtttgacctaattttatagttgtcttacgtctcctaatgaagtgtgaacaggaagtgtcttttaaaaaacaattcttgcaatgtctagcagtcgcttttgaatattaggcaattatagaatatacttttagaaataaattatttagatacttctcaaagtatatgcatgttcttccaccccacccaccccctgcctcctgcctccttattttttcctctaggctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaaggtaaacttgatgtaaaataaactaatactacattctcctttcctattctttaacaaaagaatccaaaattttaaaactcataatcatcctcgttgttatagcatggatacaacctgtgggtctggcctggtcatctagggcagttgttttcaaacttcagtgggcatcatcagtcatctggagaaattgttaactgagattgttgggtgggacttacagagtttctgatttaagtgatctgcaatctcatttaagtgatcttcattacatccagggatgtaatgaagaccattgagagtttagaacggtgcttactataaaggcttaagataactcttctaactttgaattatattgtcatggatctgggcctgatttaaaccataaaaaattcttaaactagaagattgctaagtgacttatatttttagaggtttgtgaacttaagtcactatgtaggcatcaataatatacgtaaacaaacattgacaa

SEQ ID NO: 14543 - DNA, 1139 bp, Homo sapiens
ttctaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataat

SEQ ID NO: 14544 - DNA, 2778 bp, Homo sapiens
aatattttcttactactcattcattttaacgtttacaaaggaatatatcatttcacttaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaacaaaactctggttaatgattattcaaaaaagttgttgtgagatgggcatgctggtctgtgcctatagtcccagctactcgggaggctgaggttggagaattatttgagctcaggaggtcaaggcttcaatgggccaagaggaggctgaggtgggaggactgcttgagcccaggaggtcgaggcttcagtgagccaagatggcaacacacacacacaca

SEQ ID NO: 14545 - DNA, 1105 bp, Homo sapiens
tggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagtttt

SEQ ID NO: 14546 - DNA, 2226 bp, Homo sapiens
aagcaatttattgcttatatctcagagccgtatacagaacttttcagaatttgcatttcacttaagggtagcatattttaagaaagtttaaaaataaatttgtttaatgttcagaatggatttttatattttgcattctgatccagttttttctttcctagcttatgtggatataagaaattttaattaatgaggatattgatataaatgatggacaaatttggtatgaaaattatgactgttttaacaatataaaataactctcctattatttagactattctgtggccactagcatgctaagtattatcagatttctaaaaactagggaaggatgacaattcagattctctgttaaataggaagtgagctttttttctacatatttctacatatgaattgtggtttcattgtgatttgaagtctgagcatgaatatatttttggttcaataggacgtgacatttcgcaaggtttagagcagcttgcaggattgataattcttaagagcctgctggcttttaaactctcagaacattgcagtccaagtccctttgatcattctaattatgctttgaacgttaaaaccagaaatttaaaaaacatgttgttttaatatgttcttttggagatacgtaggaattggtataacatgtcatgcatctcagatctattctattcttttttttcttatattccctacattttcttttatactaaaagacaaaaaagcacaggtttaaaattaaggagaatagaaggcatttgaaaccacaacatattcctaaaatgtaatcacaattgtgtttattttttatcagcgtggcttgctttagtccatttagttatccagctattatgtgctctattcagttagtataatcttatgtaatgagttttaaaaataaattcaagtgtatgtaaaattgaaacacaattttgttttaagctatcttctaactacatgttacaaattaaatttttctaaaactggaatcaaatctgcaaattttgatgctttatataaataaaatatattgataacatttggttacagtattcttggtgtacatatgtagtgtttggtttttgtcaaataaaaaaagatgtaatgaattcagaaatagaagttctttcataactgttatgagtaaaactgttttgatcttaaatgatttcaacacacgtgaattcacttaaggtctaattcctcatagccttccttttcattatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcag

SEQ ID NO: 14547 - DNA, 1115 bp, Homo sapiens
tgggggactgcatcttttagggcattctagatacataataacgtagtggaaggctccacatggtcagagaatgcatgtgagagggcaagagagggctgaacttgcttttacaagaaacccattcttgcaataatgaacccactcccaggataacaacattaatttattcatgagggcagaggtgtcatgacctgatcaccccttacaggtcccaattctcaacacggttgcatttgcgattaaatttcccacatgtgaactttggggaacacattcaacccatagcaacaacatttctataataaaagacagcatctttcataggtgaggaaactgagataccaagaagtttagtgacttgctgaaatttttacagctggcatctttcacaaccaggaaagcagaattgttaggtgacttgtctaggactctttccacaatgccagtggccagagggtgatcaagtttgagaatggtaaataaatgtggtggggatttgaatgtgtggatggaaggaaaggttagatgcatttctcaatattgaactggttgttgtgaatggtaaggtgattatcacaggcatattaggcctaagtgtatgattatataatcagataaatatattttaaatatctaagatattagaaaataatttacgttggtgtaaaaaaatgaaaatttaaaaataatactagattgacagaattgggaagtaacagttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggttgatggaagtggtagtggtgatggggacatggaattcttccttccaactattcacaaacgtggtaagcagtttttccaaggtcctttactattataggtttttattttaacttctcattttagagacaatactaaccacttatt

SEQ ID NO: 14548 - DNA, 1168 bp, Homo sapiens
cctgattttttttttccattctggaggggtgagtggggtttcatttatctgtgtgttcccccgtggtggcttaggggttggatgacactttcttgaccttgccagggttggggccctggagtcaggcctagctccggcggggctgacgtggccaggggctcaggcagtggctggacacactgagctgtggagctggagggcctcaccccagatctcctagcggtgtggactgtgagagcgagccggagaagatgcgcggggcgcgtgtggctgcgggaagagcttctgcattgtgttgggtacgctgcggcgcggcaatgttcgcaagctccctggatgcacattgcctcttttctctctttctttttgtcagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcaggtgaggctgcggtcgcggggagggcaggccgcgccggcagcgagcgcaggccccgcgccgcccgggcctggccttcggagcctcccgcgcggccggtgcggggcgggccgggccctcgctggacactgagcctggcccgggtctgtgacccccgcgcggtgaccggctggccgcgccgctgccatcttgggagcgcggcggtgcgggaaccgaggcggcgcgggtgcggccggcgggcggccgggcctagtcgcccggacccctacg

SEQ ID NO: 14549 - DNA, 2595 bp, Homo sapiens
ccgctgctgcttccccctccttaatcatgtccatctttccccgctctcaactggagcaaacttctattccagacttcagatttccattttcactaggtttttccctgagggcatcttattacccacctctttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaacaacagcggtgttattattcttgctcagaagaattcttgcttattcacc

SEQ ID NO: 14550 - DNA, 2132 bp, Homo sapiens
tgctatgtgccaggcacagtcctaggccctgagttacagagaaaaagagtttgacacggtcattgctatcatggcttacaccttccagagcctctaatagaggttttgtaaaaagggagaaagtatgcacgtattaatgcaagtactagacataattaaagtaattaataacattgacaagaattactaaactattgaaatataatacagtttctttaaaaatacatactgtatattcagaaagggtaatgttatttttacatcttaaaaagaattcattttcatctctggttcaaaatatatatctttaaaaaaaaaactttttgcctggtgtgattccgtcctgcgcggctgttctctgcagcagcgttgttttatctccgtccgccttctctcctacctaagtgcgtgccgccacccgatggaagattcgatggacatggacatgagccccctgaggccccagaactatcttttcggttgtgaactaaaggccgacaaagatgatcactttaaggtggataatgatgaaaatgagcgccagttatccttaagaacggccagtttagggctggtgcaaaggatgaactgcacattgttgaagcagaggccatgaattacgaaggcagtccaattaaagtaacactggcaactttgaaaatgtctgtacagccaacagtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactctgaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcaacaccaagatcaaaaggacaagaatccttcaaaaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactaaccaagaggctattcaagatctctggcagtggaggaagtctctttaagaaaatagtttaaacaatttgttaaaaattttccgtcttatttcatttctgttaacagttgatatctggctgtcctttttataatgcagagtgagaactttctctaccgtgtttgataaatgttgtccaggttctattgccaagaatgtgttgtccaaaatgcctgtttagtttttaaagatcaactccaccctttgcttggttttaagtatgtatggaatgttatgataggacatagtactagcggtggtcagacatggaaatggtggggagacaaaaatatacatgtgaaataaaactcagtattttaataaagtaaaaaaaaaaaaaaaactttttgcctaatcaaaatttattcaagagctgttcctttctttcagttactagaaaaagagaaattcagggaaattttatatctaaaaactgggactttttacaaggtgggaagtcaccaagaccttgtgttatctgaagttaaattttatccaaatttcaggactaatattgcaatgacaaatattagtaagccacacacattttttccagtgggcaagatcaaatggcttgtgagaaatgttttttttttttttttttaagttagactgtatcctaaaattaagggacaaactatttagtactttgatgttttgccaaatttattaattataacaggtaatattttagagtatttgttactgaatcatcctcctaatttaaaccttctgcattgggataaaaatctcattttgaattaaagctatttctttatgtgaaataagctgaagccacttaagagaatttaaatgaagaaaacattaaataatggaatt

SEQ ID NO: 14551 - DNA, 1180 bp, Homo sapiens
cttccattctgcctcttattgattcgcaaaaaccattagtgatctcacataaatatctaaacactttttcagtgcactaagaaagagaaagcattaagttagctattttttccacaaatgtgtgaaggtaagaagggaactaaccctgtttgcatccctgctttgtgccattcactttatgtgcatcttatttgctcccaacagcttacctttatagtgggtgttatgatctttttttacagatgagtaaacagaggttcatgtggtttgtaagtgggggagttgagattctaatccagatctgatagttgcaaaccacactacttcgccgacactcgccagagaacggcagcaccagaggcagttcctgaaggtttgccatggtagcagcctctggaagaggaacagggaatttgtcttcaagctgtattgtatacttacaaatatattgtgtatgtgtttagggtaatttggggaaaactaataaaattcatgaggaggccaaagtccctgcacatttgcaagttataccttggtgcttttccagaaggactatatgggagtgattgtggtagaaatgaaataagcagctgataaatgggtcatttttaattttcattttttatttaaactatcgatctttttattgcaataaaatgtcacaagtaaaaataaagaatttatgacagttttaacgtggtggaaggtagagcaaacaaatggagaaaaaatccaggtgaaggattaataattaaataatgaaactcttaaacttgaaaatatctgtgaactttaacaaaaatatgtataatagatatggatgcaaattccctttgatgcttacatctgagaacccagggaagtgaaaggaacatattaagaaggagacttcatagcaacactggactgagagttaagagaatcaagcccacttcacccctacccaacccaacccttccattagtggatctggctccttctttccttcatttattcagaaatgcttattgagccccctgtatgtcagatacttttctgaatactagggatttggctatgaaaaggataagcaaaattccttttcatagccaaatgtaagctctgttgcatagagcttacatttcagaagagaaaatagatactaggtagacaaatcgacatataaagtttatgttttaga

SEQ ID NO: 14552 - DNA, 1097 bp, Homo sapiens
gtttgagaccagcctctggccaacatggtgaaaccccatctctactaaaaatacaaaaattagccaggtgtggtggtgggcgcctgtaatcccagctgcttggaaggctgaggtgggagaatctctcaaacccaggaggtggaggttgcagtgagccaccaagatcagacgattacactccagcctgggtgacagagagagattccgtccaaaaaaaaaaaaaaaaaaagcaatcagaatgttggcatctatactaatttgaatgaattgtgcatctctctgatgttagcttcgtttaaacaatttatatctgcaaaagtgactgaaagattgcacagagtcacttttcctagtatagtttgatgttgccttttcaagactgccgcccttggattacttggcttcaatgaatcaaaatatagatattgttaataaacaaaatactgacgttcctgtatgtgatttcccataggtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagac

SEQ ID NO: 14553 - DNA, 1710 bp, Homo sapiens
aagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaat

SEQ ID NO: 14554 - DNA, 1148 bp, Homo sapiens
ttcaccatgttcactgtattatagtttgcttttcagaaatggcatatatttatttaagatataagttatcaagtctgttgttacagtttgtgttactagttattatctttctgtagcaaaatgaccaaaatacatgcattatacatattatttccaagaaatgattttattaaaataatttctaattcaaattttagaccatttatttaaaatgctttctgtttgcatgccttcttaaagattgaaataaagtggcctttattattatttcctctagaaatgaagaggtacctaaatcagaattgtggaaactgaggtgctcatattgtaacccacaaatgtgtaacaatgtcatttccactggactttagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtgaggacagctggagagaggtccttcctgcttaccttcttgttaaaatgttcatttaaaaaagcttgttgtcattattatcattattattgagatagagaaattttaggattattttgatcagtggtatgtgaaatacaactcctgaatattaagttaaatcatctcattttaagcacttaattaaaaactagttgaaatgtgagcattgtctttatttgggaccaacaaattttgttctcaaattccattaaaaagaaagtaagaagtgtttgttatctgtttttagtgttgaatacactaaagtattgccttaatttgtattgattattgtcggtgaaattgtgcaatgtattctattggcctttgattggtataagccagaacattttttgcctactaaatagtttaaaatgtatcttgccccacatactttgtgctgcccttattactctatctttttctgccactaagtgtgccaagatcagtcatttgtctgcataaaagcatatgaaat

SEQ ID NO: 14555 - DNA, 1222 bp, Homo sapiens
caccaagttccacagcttccgcagccgtcggggaacaaagtccttatttggtcacggccatccccttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaaggtgagcgggccggccggcaggctgggctcagagaggcagagcgcacccctcacggcctggccgcgcccgggtgcggggccggcggagccgtggctggcagctgctaccgtcagcgcccgcagcggccaggcagggcagggccgggcagggtggctgacgccgcggtcccgggctagcctgggcgttggggaagcgggcagtcgggcggcccctggcggcggggccgaggcagccgcagccctgggtcggctgcgctgccgctgcgggactttccgacggcccccgaggatttcctggcttgttgggtcccaaggagggagagaggccccgataagagaagtgagatgaccacgctaccctcggcggggaaggagggtagcgagcagcgtatgggcaaggaaccagggacgactcgcgggcaccagctgcccgcgttttc

SEQ ID NO: 14556 - DNA, 1119 bp, Homo sapiens
ccagccctgaaactcctttggtcagtagaagccctgtggagaaaacaggcttccgagcctcctcttctgagacaagccaggctgtcccacaggaaatggagaggaatggcctcttgtgggctctctgaaaatctttcctgtgccgtctatggaatgatctccataaagaccacgtctttcttttttcctggtatgcaacttatctgtgatacacctcagtccattgtctttcttatttctaaaccaactctgggtcaggtctcgtaagtttcacattatcaacatataatttgcacacaatgtttaatataagaaatttgctcgaatgttaaacgttttgttttttaaacatagattctaattcagttgataactcgagttattaaaagatagcgtgtgccttttatctgaaataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccagctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagac

SEQ ID NO: 14557 - DNA, 2154 bp, Homo sapiens
tccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccgacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttac

SEQ ID NO: 14558 - DNA, 2527 bp, Homo sapiens
tatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaacattgtgtggactctttggattaatgtatatataaagtggtatctcttcttaggttatgacctctaccagggcagctcctgtactcattgtcttctgtggttagttttttatttcaccagtatccagtgtctttattgcatatacctcagttgacatttgacattcggaggtggctaattctttgttgtgggggctgttctgtgtatcataggacatttagcaggatccctcccatgccaattgcaactagttgccaatagtaactcttgtccccagctgtgacaactaaaacctctcctccagacattgccaaatgtcccctgaggttagggttaaaactttgagtggatgcatagggcggatagctaacagtcacgggagctccatcaggaccattatttactttttggactaaagcagttcttgtaaacactcaggtcacctaagtagccaactgatgcag

SEQ ID NO: 14559 - DNA, 1124 bp, Homo sapiens
ttccatcagttttcatgatggacactaggtggcactatggtaattttttaaaaattctgcctatacactatattttttgctatataatctgtatttctgtttggaatttaatttctcctatataacagtttctatatagtactgtcagtgtttggaatcttaaaattcatggtgtcaatatataaatagaacagatattagcagtgtactttttgaaatggttcattatcagtaatactaatttatgaaatctttccaggaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagccagcttttggggagaataatatatttaggatcttggatatgtttaatatattttttaaagttactgtaattcctttttgagccctcatttgtcttttttgagccaaggctatcatatattaataaataaaccctctttcatctataaatttggtcattcagtatgtgtcttgcaaagaataattacctgccaaagcagtccatttttttcaaagtaatttgggtaactacagttacgtaactttattagagacatttgcatatttttaaaaatctaaataacatttttgttgttttctgtttgttgaggatgatatgctacaatgcacataaagcaattagaacaatgtttagcacattcttaagcattcaataaaacatggctattagaatcataatgattctgaaattctgctgacaatttggttgcattttatttggcaactggaggacttcactgtcttatttttctttagaagtaaagataagcctttggaagtaaagataagccagtgatgcacaatttgcttaattaattgattaataatctgttttgtgccacttacattggtaatgtggtcatgagaatggaaacttacttgagatagtctaccacaatttttacagttggcagcttgtaagcaggcctgagtagcagaagagttaggggttggggaaggtggagtagaatgaggaatgaaatgttctttctcatatgct

SEQ ID NO: 14560 - DNA, 1249 bp, Homo sapiens
ttatattgttgcttttcagttattttattcttaaaatgacagccagcatatacctttcatatttgtttacctgtgtcatttaaatattacattttagggaaggaaaatttatttttaacatataagctattaaactcacttgaatcataatttatcagagtagtagatatttgctcctcttagataaacattttttctctctttctatgcttgacgccttttttttctaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcaggtatagacttctgtcgattgctttttaactttagtcttgagactgatactttgttagattctagtaaaagaatgtttttttcaaatgatgtgacaaaattgtattctgccaccttgatgtataaaatgaaagccaaataattttttgttgttaaaaactcaaaatagcttccttttcaattgacctgattctaggcagcctattgactaaatttcaagtaattctgccttaaaatacaaactgatggctgggcacagtggctcgctcatgcctgtaatctcagcacttctgggaggccaaggcaggcaaatcacctgaggtcaggagtttgagaccagccaggccaacatggcaaaaccctgtctctactaaaaatataaaaattaaccgggcatggtggcctgtgcttgtaatcccagctacttgggagactgaggcaggagaatcacttgaacctgggaggcagaggttgcagtaagccaaagatcgtacca

SEQ ID NO: 14561 - DNA, 1479 bp, Homo sapiens
tctcctgctgactccattctctgaagttgtgtatcatattacctgtgcaagcaggtagaattttcgactattttctattgttatataatattttaatctgtaaagctaatttctggaattttgtattttttttttttactggggtttttccccttctctctttatacacacacactctttctctctgccatccatttttttttatcctctcttttggaaaaagaacaaatgcccagaatggacagaagcagaatgatggcaccattcaaaggcaggaagagccgggagagatctgatggagtcaggatagagatctggttctggctttcatccactaacttcctactctgtgcagggtatataatggaagtaaacaccacccacgtgtatcccttgtccctggcatgcggaatcatccatacctgttaaaatactgaaggggtttcctttgatctctaggggattacgtatcatttgagggaggaagcacgtgttctgtgaggttgtgaggcttaggtctaagcactgtcatttactaatgtacccctgcttttgcttttggtaatataatcttatgttctccctgccaaccttaaccatgcccctgagggtggcagggcagcagcaccccagagagatgtgcttaggaccccagaggtggcctgggtgagtgaggatggggcagtggacatgggtcttgaaagagtcagtagaggcgagggtaaagagcatgaactgctagtggcacgaaggattctaaggtttaaagacctggctgggagctaaaacagagatgatggagttcaagaaaacactccctctctggtgaatggggagttttttcagtggactcttggcactagctcttagggccctaacccctgtttcctgctgcagtatgggtcagatatattctttatcacatgaagagggtgcttacatgtacaattttgtggatatcctatcaaataaatatattccttttctaatttaaacaaaaaaaaatgcctgcttgacaattgatctataaactggcgtatttgacataaaattaatatctatcatgtttacaaacctaatcctgcacatagctggacatagaaaaactaaaaataacattttttcagaatttgaaagtaacatactgtaaacacataaaatagaatttacaatttaagagaaaaaaattacaatatacattttagtttataccatttcagtacatatatgtgtgtaaatatatacgtactcatgtatttatacaggaatatatgcatatatgtttgtaacctgtgtttttaactagagagtgtatgagaaactttttgtgccattaattattcatactaatattggcaagactgcatagtactacacagtataacaagatgatttatttcactatattccaatttgagcatatgtaatataattttcctaaatttttaccattataaataacacagcagtaaatatcct

SEQ ID NO: 14562 - DNA, 1239 bp, Homo sapiens
aaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaatgtctgttctgtgattatagggacacctgctggaagaactgagagctgcagaagaaagggagtcgggggagggggaattgtataaaatccctaaaggttactgataagtcatgccacctgcccacaaattcgctgattttcaaaactatagcattactgtcattttttttcttttgaaattttaagcagttacaaatccgtatcagtgagattggtccactagtattgtcccaaagttctgtctttagtaacagttttggtcccttgaagacatacagcctgcactctagttctttttaaggtgatgtgaacagtaacgacttcctcctggtggggaggatttgggaaggcaggattttctggctttgaaaacaaatcctcacttcttgggttttaaaaagagacatcaagagatcacaagttggtctttgttcaagaaacacaccaaagggtagaaaagttaggaaaataactgaaacaaaaggcacagagaagcactgttacttgt

SEQ ID NO: 14563 - DNA, 1174 bp, Homo sapiens
attgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagatttttattttgttttatattcagcgggaagtttttaagtcatgtggcacacattcttgcatgtatgctttgatgtaacaaatttgaatctttgacgaatataagtatgtggacataatttctatagtattgctatgtgtgtcactgttaattagctgtgggagcaacctacagatatttgtccataggtgtattttttaatattttcctttgtccaattaggtttatgtgtataaaagcttgtgggtttttttgctttttgttttgttttttgcagtaatttctctttctgatacagttaccctgaagaataataatgctttgtttc

SEQ ID NO: 14564 - DNA, 1105 bp, Homo sapiens
tgagtaggaattgggtggttctgcttttgggtatttgttataactgaacaaaacaagtttggtgtctaatctttgcatgttatttatttatcgctaaactgcttagactacacaattttttttattaatttgactcaatagtgatcctttcgaataataaaagtagttttgatgcatttgatttttaaaaattctcacggtgtttatgactcccaaagttactaattttttgtggaaattctgtatttttctagtttcttaacaacagggtaatttcctttttgaaagtaaccctgttaaaagcatttctgatatgttcaagtaggaattgagatgaggtaagattggccaggcaggatatatttattgtagtgtccattcagaatatgtttatatatacacatttatttaagaggaatgggataacagcttacttttgtttatgtaatagttttggatatgacatttattaaaatcttattcagttttgtattttgaaagtttctttgaagccattgtaacttttttcttttaaaatcttagacctgacaaaattcttccttattctttctaccagaaaatttaatacattgttagtctttttaaaaggcactttcatgaccacctgaattgctgtacttttcgtctttagttgaggaagcatttcgacttctactttacctggatatttttcctcatttattaaccacttacgtagctttcttaagtaaaattttaattttgcattgttggtgtaatacacatctgaattaaagctattcagtgaatttttatcagcacttggaatgtgaggaagtgtaatataattgataattattgtggagacacttcctgtggtagcttcagaccttcttttggtcttatgaaaataatgaagtaatttttaaaacaaaatttagcttctattgttttatttatactgatatctaaacatcatcttggatgttaatttaccttgtcttacctggtgtatcttaatgttttaacatttttgtttttagcatagtttattcattcttcttagataacagtgccttgaatttttatactaacaagtattttcttatatctgtaaatatcagaa

SEQ ID NO: 14565 - DNA, 1052 bp, Homo sapiens
acatacttcaaatacctggtttcatcgctacagatttgtaattttaggggtaatctctttcacttctatgcttcaagttccttattttaaaataaatatactgcactaggcaacatagtgaaaccccacctctgcaaaaaataaaaaacttagctgggcatggtgacacacaactgtagtcccagctactcaggaggctgaggtgggaggatcagttgagcccgggaggcggaggttgcagtgagctaagattgtgccagtgcacttcagcctgggtgacagaaggagacactgtctccaaaaaaaaaaaaaaggattctaatacttgatttgtctaacttcttcatgtaactgttgtaaaggtgaaaatgtcagtaattaataaaagtgctgtgtaactgttatatttttaactgttaatgttaagcatttttgtttttcctgttttagttctactcctttcaataaagaagagttatcagccattttaaagtttggtgctgaagaactttttaaggaacctgaaggagaagaacaagagccccaggtaaaaaaaaaaaaaaaaaaaaaaaaggcctgcctcagaatatgtgtcatatatttgacaggatgaaaggattcaagtatatttaaatattgtctttttaattataggaaatggatatagatgaaatcttgaagagagctgaaactcatgaaaatgaaccaggtcctttaactgtaggagatgaattgctttcccagttcaaggtagatttaaacaaaattttccttgtaattacataaattgagaggaattgagttatgtcatttagtggtttgttaatctttctttaagcataatcaggaagattgctgtgttatgtaaaaactactctctcttgttcagacaaaccagtagcaaactgatttgaaagagaccaaacccatttatgaagttacatttagttgggtggaaagagctgttgtttcctaattagcaactagaatagtgtttggcaaatagcatgtccttaaatacttaggtaaataaatgaatcagtgtgatctct

SEQ ID NO: 14566 - DNA, 1299 bp, Homo sapiens
atgaggataaactttattatgaatataacctagtctttactcacagtagttaaatataaaattcctttaaatagttagaatttctgtttaatagataatttctgaaataatttagacaaaataagcatgtgttattggtgttctttttaataatttttaagactaagtacttttattatattcttccttcccctccaaatctttctgaatagttttaaatgtttttaaaattgttctagaaaggatatttatggtatttttttctttttcttgcagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaagtggtccaaattatgtgtttataaaataaacataagactatagaattaaaaattaatatatgtatttgtaatttgtcggaaaatctatcaaaatgttattctattttagcaactactatgtaacatatctgctttgattagatatttcagaaatctgtgaattttacagccatttaatatctttactgtatagtaagatgtagaaatggcaataatggcatagttcaaatacttcattgtgttatggaacaggggattgaggaattaaacacatagactttggagtcagatctatattcagagactgacttcacgatctctgaacaaattatttaacctcactgagattcaatttttcacattctagaagttagaggagaacttataggaaaagcatgggtcatgaactcagttgcttactgagaccagggacgtaatttaaatgtgcatgtaagtcaggat

SEQ ID NO: 14567 - DNA, 1294 bp, Homo sapiens
gagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaataca

SEQ ID NO: 14568 - DNA, 1183 bp, Homo sapiens
ctttagcaccaaaaaaaaaaaaaaaaaaaaaaaagtttctggcctttggaacaatgaaagcactgcttctctttgatttctctggctctgctctgattcgttgaggccttaatgtctaaaaaagatttatagtaaggataaaggatatggaaggatggagttgagatgtaaaatgactttaagaaataattactgttgaaagaagtgtagaatgtgcaaggtcatgtaacttatattcccattaaattgttttgtaagtcaataatcactgtagcaggttacaaactgaagtaatggccacaaaagtcaaatacagataattccacatcataaatatggtttgtttccacttgcttaatttcttaagggttaaatattctctcagcataatttgttgaatatggattaagacagtatgagagtgtttgccatgtctagagaatacctaatttacaataatttattttctaaatgatcactttcattgtttttatgtctaatatttttaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtatgtagcacgttgagaaattttcattccctaaggcaacatgttgatggaaaacaaatggactcggggttcatttggggttcatattgaccattggttcaataccaatcagcccttacaagatcattagttctgtggcattggacaagctcctctgtagaaccccagatgtaggagatttaaatgatatgcaggtgaaagtgtcttcacattgcctgcctggcttgtgcttggtgttttctctgcttctttcatgaagcttcaggtgtgagctggagaaacgttcagttttgagtatcatagaaataaaatgcattccaatatgccagaatcagaatggcatgcattctaccttatgcattaggcactgtgacgttaaatcttccttaagcagtgctaatcaataagaaactggctattacctgtgttgttcacctgtgttttatgtttccagttgctcttcctccttgtatcccactgcac

SEQ ID NO: 14569 - DNA, 1102 bp, Homo sapiens
gtggcaggaaataaatgaggaaattctattttcttagtcactattcttaaaaacgcacaaatttgccagtgtgtgttttaatatattttttctgtttcattttaatgctattagttcatcctatttaatgaaagtattcagcactttagcagagatatgagagtcagaaataagtgagtttaagtttttgctcacacactgtgatagaactacagtgatcctggagataagtttctttgactataaattatgttgataataatcaataccacatagaagagtatacatatgtggtgataaggcagtgcctggtgtgtggtgagtgctcattaaatagtagcaatgaataataaagtctttttttttttgtggatgtcacttggtgttgacatatccccaaagtctgaccaaacacttttgaactagtacattagaaagggttttaattagatatatttctaagatcatattgttacgagataagaaaataattcatttggtgtagctcagcttaattgggtccacttagaataacacattaaaatattgccttttaaatagccaagttgccatttgaaaatatcttgaattttttgactttgaacatgatatgtactttgtaaaatgttcagaaaataggaacacacaaacaaaaatggaataaagaaagaaagaaagagttttcatggtaacacaccttggttattcaccgttaacactgttcagtcttttaaaaatgtatatacacattcatacgtatattgtcatacataaactacactacacagtcattaacacacattcatgcacacattcacactcacataattttattaacattcacacatctttacatcacattctcacaaacacattcaaaatccttgtttgaaggaaacaagatttttaatctaggaacgttgacttctttttacttggaagatgtgttggacacattttatattagtaaagatggagttgcagaatctttttgcttttctattatttcattttataaatgacttatttaaccaaccctcctttgttatattttttattaatacatttaatttttctggttagagaggttctatgggtcatg

SEQ ID NO: 14570 - DNA, 1725 bp, Homo sapiens
agtaaaatgagaaattaattttgtgaacacagcccattgtcattacctttctatatttgtgttgaattctgaaaagtaaaaggttaaaaatgctatattaaatttttacatttcatttacatcacaattataacaagaattgttttgtcaatcagcagtattatttgaacttggattgtttgtgtaaatttaagcaatagttttttttttttgtttttgttttatgtagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaa

SEQ ID NO: 14571 - DNA, 2061 bp, Homo sapiens
gactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcaccttt

SEQ ID NO: 14572 - DNA, 1198 bp, Homo sapiens
tatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatg

SEQ ID NO: 14573 - DNA, 1119 bp, Homo sapiens
cctcaccaatgtcctacctggacatcctccctcactcctcctccttctcacactctcctccctatgaccagtcctttaatatcccctctcctttgacagctcttcaccaccttttgctcagattctggtccttccccagggtgaaggctctctccaatttcttctattggagagtgttcttctcaatgcagtagctcttacagaatttacataagagattcatatcctccttgctctcatttggtttgggctgtacaatgtgttggtgtttctgtctcctttatagactcttagagctacaggataagccctcttctaagaacagagacatggaatgctcagtctctgtcttgattgctgggtcagcaggtaaagtgatggcagtgctgccacctgaagagtgtccaccgacacaacgtatgatgagagagacccttggcagggctgtgctgccattgatgttgtggagtttgttcctcactaacaatgtttttttctggttaatttgagagaatgtctgtatttgctgtttctgtaatcttattttgtgtttcagttgagtaagtgttgctgaatatctgtagaatgtgtgataattttttgtaaaaaaaaactcaataaaagaaacattagcatagaaaaatattttatgttgtgtaaaacacttggctgaggaaatgttttaatgcattatatcaaaatgctacagactctcagcagttagattacaggagacagctctgtttggcactgaaggagaccccactcagcactgccaggttgggagaagggcactgagggagcgaggatcagaaataggattgagtatcaaagggttcccttcaaggaaaccagcatttggtcagcaccttcaatgcaaatcattgctctaggttccttggaagacacattaattaaaaagacatccaatctatcttccagtagcctacaagctagagatgatctgggtataaacattaattcatttggcctgtctttatgagagttactatgagcaagggactgtgcaggatgtcaagaaacaaagataaaacagatgtggaccatgcccttagttcagtagtggtgaaaaggcactttcacgagtcatcctaagat

SEQ ID NO: 14574 - DNA, 1234 bp, Homo sapiens
tgtgaccccagtcagagtctatgttcccactcatcttcatttgttgaccttatgtttcgaatggaaagacatcaattttttcaaggtacctctctgctcacaaagatttccctaattttttaagaggctggaagcagtcaatggtacaaataaaacacattttcgacagtgctgaggctcagaactgtggttgagatgataaaatggttttattttctagatgactatttttcaaactagaaatatgttttgcatcagtgatgtgttaaggtcaagtcaagaaaagagacaatatgtcccatgtcacggagaccaggataatgagagtgttctctgggagatggctcagaatctgttcatttcaccggcaaaaggttataccagacagattgtttctcatttgatgtctaaattaaactgctgacatggcctgcctcaaagtaagaagcatacgtgtttgccaaacagaccctaaagaaaatccctgtttgagagatttggttcctttttctgcaacctttgaggcttttctgtgtttaaggtatgcttaggaattaaaccaggttttcagctacagagcagctccctaaatgttcatgaaggaggcttggtgaatctgagacttgctgttttgtcaaagtgctgtgggatagaagcgagataaatgctagttcctatttggagtttagaaacatcacacatgcaagatgcacaagatcatagaggaattactgaagatagaaaggacctatggaagattcgctttagccattgccctccactctggccctgctttccctcaatggccattttcacctacctcagagctcaaagaagaccaaattggccaatgtcatggtgaatggtctgcagaccagcaacatcagcctcacatgccctatcccaggcatcagaatctgcaccagaacaaaatctgcagacgattcagcaggactgatcctcagtcaaaagaggatcagctagacacagttctaggtttgggggatacagtagggaatagaacagacaagtcctgcttgtgttgcatttacattttaatgggaaaaggagaaaaagcaataaacaagcagacaggtaagtatttgagtttctgatggtcatagtgttaaggcagggaaagaagggaaggaagcctggatgtggattgagggttactacttgtacatggtaatcagggaaaccctcaccaagagggtaaaatgtgaacagagat

SEQ ID NO: 14575 - DNA, 1198 bp, Homo sapiens
gagttgctattgtattttttaaaagctgcagataaggagatgctatgatagctctctataatttttcagttataagttttttccattaggttaagttttttgagttttgttttgttttttaaatcaaaatctctaccagcttactgggacatagactaagaaattaaagaatgtgagttgtgttttccttgccaaaatggagtcttttctcaaatttacatggagccaaattgcagacacatccacagacaggatgagtatcagtctaagaatgcagtcttgggtccttttttttttttttttttttttttcccatgaaaacaagcaagttcacaagtatgaagaatatagaagcacctttacctcagctaaggggctcaaggaaggtttattggatgtgactttcttggagctatctgggcttcaaaatatacttaaatattcatatgcataaaagaaggtgggggaattttagctgcagatgttggtaaagcagaagagagaagagagcaaggtagaatcagaagactgagtgttccattgtgaccaaacatctgttgtagaaaatctggtcatgaagagataccttgggttacacttcatgttctttataaaatactacagcagatgaataaatacattaatagcatgttatttgtatatgtgtgtgtgtgtgtgtgtgtgtgtgtgagaatgctgttcttctggtaaaacttgttaattgtctatgttcatttattgaagaatgtgtttagtatctgaataattttgcatggtgggatctgtaatgttatattttctcctttaagcattgaaattcatcatgtaaggcagtggtccccaacctttttggcaccagggactggttttgtggaagacagttcttccgtggactcggggtcggggagcggttggtttcagaatggaaccgtttcaccttagatcatcaggtgttaagttcttataaggggcatgcaacctagatccctcacttgagcagttcataacagggttcatgctcctgtgagaatcttttattattattattattattattatactttatgttctggggtacatgtgcagaacgtgcaggtttgttacataggtataaacatgccatggtggtttgctgcacccatcaacccgtcatctacattaggtattcatcctaatgctatccgtccactgtaagaat

SEQ ID NO: 14576 - DNA, 1190 bp, Homo sapiens
tcatttgagtttttataacccaatctccagcttccttcctctcctgtaagtagtgttgaaagttatcaccctctaatcaagggtttagtttttctggtaaccagcccccattctgaagccatctaggcgccccactctaagtcacttcattagtatgaactcagatatggtctaaagggcttgttatgaataactaaagaaattctattgcttaggaaattccaagagttttgggaaatatgtggcaagaattcaggacaaagaccaattacaatattattattataccaaattcttgttatgcttcaatgttaagacggtttctcttttgattatatcgttcatgctataatctaattagtatattgtttattgtggaacatttaattaaaaaatggaaaatacgtttttatttttagcaaaagtttaaatttattgctttttctcttacaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcaggtaaattttagcatttataaagtgattttacttgaattaattaaaaatgttttctagcaacaacattttaaatggttacgttaaaaatagttcccagagactcaagtgaatcatcttttttacctattaatgaatatttgtttagattagttaactagagtgccatggttataatcagtaaattaactgctttgttttatagtgagagcctgaacttctgtgaccagccattttataaatttatgcttttgttacttaaattttttaccacattttgctttgggcaactgcgtagttttggtcagcatgaggttttaaaaattaacattttaattccccttttattatactagatgacatacatgcttaaatatctgaatgtttaagggataaatggacgtccaaattgaagattataaaagttagaacaaaggcctaattacctctatttggtacaataactgggttaaaaatagtat

SEQ ID NO: 14577 - DNA, 1120 bp, Homo sapiens
ttactaaatgttaagtcactgctgaaatgggaaataggcttttagaatggcccaacaacaggtttaaaatcagaaatcaaacagtaggaatagatgtttatttgactagaaaagtataaagagagtgccccagcaattgatgatcacatctgttatggtttgaattatgtgcccccaaaagatatctttaagttgtaatactaaatacctgtgtatgtgacctactttggaaatagggtctgtagttgtaaactagttaatatgaagttgttagggtgagctctaatccagtgtgactggtgcccttataagaagagaagagaggctgacatacagggaagacagccatgagaagacagaggcagatattggaattatgctatcacaagcaaaggaatgcctggggctaccagaagctataggaagtaaggaagggttatcccctagaaattttggagggagcatggccttggctaacaccttgatttcagacttctggcctccagaactgtaggagagtaagtttctgttgttagaagtcacccgatttctggtactgtgttacagcagccctagggaattagtacaacatctgttgtgattattgtctttataaatgatctgaaagaggagggtcttcctagtgaggtatctagatgacattaaagtcttctagttgtgaagagcaaaaccagtgagtacagatgatgaacaaagaaacaccaaaattagcttctctctgtgctagaacaagtaacaaatccagcatcttaagattttatattctttgactgtaagcactgatttcaacacatttaatgttgaaaattgcttccagatttaatgttttatgattttatgagcctgggtaagtgcctggcacctaattaatgcttaatgaatatttaaaaaataaataagtgaaaccaatcagggaataaaatataggaaaatataattttattttaatgaaaatataaacttattctggtataaaattcaaattatggttacagttagggaaaaatgagtgcagggagtgaatactgggaaactatacgcattgtttactgaatatatcaacacttaagtagaaaaacaaaattaataaattgttaat

SEQ ID NO: 14578 - DNA, 1185 bp, Homo sapiens
tgaggtgggctagagagagacagggccagatgcagcagaaaaagagttgccaaactctctggtacctcagccactttccaacctttgggaagccctaagaattgtcttatcagagtctactcagtatctactaggcacatgcagctatttaatgtaactaaaagtatataaaatgaaaaattcagtttcttggtcacactagccacattgcaggtgtccagcagcacatgtggcagatggctactttattggacaatgctgctctaggaaagccaaaggagaaataatgccaactttgcttagcctcttctctgtaattttctcttttaaagctagaatcggtgtttttctatttaaatggaaatatatgtggtacctagaaaactagcatgtggcctactccatatgcatatgttctcatggatgttttttacctatgacagaaaagatgaggactggtaaatcacaagcattcttaacctcattataaatacattgcaaatgtaaaaatgcaaagtgtggaaatcataaatgtgaaagtggctttcaatttgttttaataggcgttttctgtgtcttactgtaacctagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatggtaagaatagaccacattttttttttaatggtaaaaatgaacggcatcagcataaaacattcacaagcaatatttacaggggtagcacagaatgcaagttagaatgatttgaggatcaacacaaataagtgaatttcatacttttaatttgttgaaattattgatcagatttctatatgtaacattgctatattaaaaaggtagatataagtacttttaaatatgactatacatctgagaaagagtttttataccaaaaaaaaatgactttgtaatagattatacagagtaagcgttgttgtggctctggaccatttctttcgaatgtcttataattggtccaataacctcatctgatgttaggttcctaaaatattaagtcaatcagttctttagtttctcactctgaaatcgacatggtttcttagcatctcagtct

SEQ ID NO: 14579 - DNA, 3002 bp, Homo sapiens
taaaactcactaaattaaggaggatgaatgaccttaaagatacgaacatgaataagagacatcatttaccctcaaagaaactagagtctgattgggcagggaggaaaaggtattaaaattatgtctttctgcattgtgtggatttgaagtttgttttttgttgttaagagtcttattattaggataatgacactgttttttctttattaagttacttgtgtggcagttaagatgattctggtggctcttaacattttttttttctccagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaattgtgtaattgtatcacttctataatgtaacccctgaaggatttagagttaatgacagataacactactgagcatgtgat

SEQ ID NO: 14580 - DNA, 1215 bp, Homo sapiens
agtgctcaattacagtgcaattgcaagattttattagctagtggaaataattgtgtggtttttttttagttagaaagtactataaaggaagaaatttaccattttgaatatgaatgcattttaattcatgtcataaaacaattcatttgattttctttggacatatgaattaagctactataatacagattgtgtaatttattatagaaaatatttaaaatataatttctgctgctctgtcaaagtctgtaaactttaagggttagtaagtaatttttgtatgatatactgtttttaagctaaaggtaaagtttttttcagttcaagcccacagtgttttattcagtatccacacttctaaaaacagaaattggccacaaagcctgacctgatgttaacttcctggataagcagatctggatctgaattgaaatgagggtattttttcaaatatttgtatattttactgcagaaatatagttatgtttgattactgtgtgtggcctggaccatgttggggtttgttaagtagtagttctaaatctgggaaatatatatcaaaattccaaaacacatttagccctaagattttgaaatagattgcaagtctctaatattatacctctaggttactatttttaaaaaaagacaaaacttacagtctttgataatttatttttttgaaagtgtaaggtgcttgtattttttttcccccagttacactttttcttctttaaggagaatcatttaatttggctatacctttgtcattttgggcaaaataaatacttctcttctgcttgctttttatagtcagttataatgtcttatgatgaagttgatgaaattgttacattgtttgccaacccctagagaaaggtagtcttcctggctccttgattttaaattgattttctttgttttgggggtggtcagtggtggaagtgtattctttgccttgaaggaccctggacttttcatagttataaggtattttcttagttatttgtaattcttattcttatttttaatttttttcttaagtgatgtcaatattctgaacaatgatagttttttttttttttttttacaaacaatatatagatgggaaaaaacatttacagttaatagaaactgtccttttaaattgctagtaatgtattgactacagagcctgtggttagggtatgccaaaatgatggaactactttagga

SEQ ID NO: 14581 - DNA, 1161 bp, Homo sapiens
aaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggca

SEQ ID NO: 14582 - DNA, 1146 bp, Homo sapiens
atgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctct

SEQ ID NO: 14583 - DNA, 2266 bp, Homo sapiens
gtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgtacatggtcctctagagtagttcttaatcctattttgtaaacatgtattaaaacataatgaaggggtagggggagtagtgagggtctgttctttgttccttcatgatggattgggtttttttttttttttttttggacacagagtctcgctctgtcacccaggctggagtgcagtggtgcaatctcagctcactgcaacctccgcctcctgggtccaagcgattctctgcctcagcctcccaagtggctgggattacaggcacccaccaccactcctggctaatttttgtatttttagtagagacagggtttcaccatcttggccaggctggtcttgaactcctgacctcgtgatccacccacc

SEQ ID NO: 14584 - DNA, 1257 bp, Homo sapiens
tttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagactgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaag

SEQ ID NO: 14585 - DNA, 1194 bp, Homo sapiens
aataagggatggggtcttccccctctgattttatatattctgtactgttagtaatatagttcctaatgattatgtacttttataactttataacaatagaaaagaaaaattattttacctcatcagattcccaatgctaaccactattaatacttttgtatgtatcgttataggcttcttaattaggatttactctgagagaagatatatgagcattttaaaattctaacgtgcctgttgcaaggcattagattttctttattaacaggaaaaaggtttaaattacagaaaaaaaatgtgttttgagtactttctcttatattggtgtcatcgtttgtactgattttcaattattttgggtttcattctactacataatatgaaaaaattaacccacaggaagaatttcctgtaccatttaaatatatcctatttggggtataaaaggaaaactgtaattttctaagttaaatgattataatcaagtcataactggattaaaatttaatgcagatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaaggtaagtctaatgtaagacagtactgcccagcttgtcttcttctggggcagtgctatctaacagaactttctgcaaagatgggtatgctgtatatccatcctttccagtatcatagccacttgccacatgtagctattgagttcttgaaatgtaaatagtgtgatcaagaaactggatttttaattttatagaattttaattaatttaaatttaaataaccgcatgtggctagtgactaccacattggacagctagacagtgcagcttgggagtcttgttttgtttttttactcaactgcacaataattttgactttaccccctgacatttttatgctatctgcttgatccaatgtgctgaaccattaacttttctttttttagtggttagttacattttggaagttttttgtgattatgaatagaaagttgggtttgtttgtttttttttctactactgaaatcaaaatgttcacttctatcattattaaagg

SEQ ID NO: 14586 - DNA, 1234 bp, Homo sapiens
aggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatga

SEQ ID NO: 14587 - DNA, 1115 bp, Homo sapiens
aggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatac

SEQ ID NO: 14588 - DNA, 1170 bp, Homo sapiens
gttggttactctacttttttttaaaaaaaagtcaaaaaatggaaactgctgtgagtgacaaataatgaagcttatatatgcatgaatagagtttagtatagttataaaatcttacagtaaaatgactacaacagttgtattcatagtcatagtattcatagtatgaataattgcattcataattaggaataaagggtaaggggattgcataaagcattataattgccatttataattattgctaccgttacatagcagaacaagcattctgccctcaactgaggggaaggaaagtggggaactgcgccagcgcatgagtgctggatggaacgtggctcaaagtgggtcagctcctacctcgctgtggtgggaattgccccttcttcattaaggagcacgaggaaatggaaactgagtggcttggccctgggggtccccagcatctggctaggagagtgtgggagcgattccatctctgccctcccctgaccctccagggcagcccttatccctttgactctgcttttgtgggaactccagtgccctctgtgcttccttggcttctgccctgctcttcccacagatggagaggcgaagctagaggcttacctcatctctttccttcgataattctacttaataattgtgagatttaaaggaaggcctctccccaggaccccgaattctcctgccaccacttgaaattctgttcattaactgttaatttgaattaataagtaggtatcttagactggccaaaggcagttattagaggtaacctaatcattcttagcatgtgtagcctgagctaggggctattctaaagactttacctggattaacttatttaatctgcacaggaaccttatgaggaaggtccagtggtgtccagttgcttgtcctaagttacatggcaatgacatggggagagtcagaacagactctctatgggtctgccctgggattcaggccctcagccactgtgctgaactgctctcctggatccttaatgacgatttgattgctttcttcctaacacctagcagcaatacctgtagggatgagactggaagcaaagatggtgaggacgtattaggaagagacatggctctaaggggagcagtgcttgggatgatggagactttggaaagagacttggaggacattttt

SEQ ID NO: 14589 - DNA, 1180 bp, Homo sapiens
ctccatggggctgcttgaatgtcttcatgacatagcagctggcttccctcaatgattctaacagaaaggccatttatgacctagactcagaagccacacaccattgcttctgctgtattctctttattagatatgagtcactaagtccagcccaccaaagagaggaattaggatccacctcttaaaggagtagggtcaaagaatttatgatatattttaagatcattacatcgaccagtgaaacagtttcactggatttatccctaggagagggatcactggataataagggcattgtttcctattgctgttgtaacaaattaacacaaacttagtggtttaagagaacacaaatgtattatcttgcagtcctggagatcagacacggttttcactggaccaaaatcaagatatcagtggctctgcgtctcctctagagattctattgaagaatccattttcttgcttttcttcagcttcttgcattccttgtctcatggcctctttctccatcttcagtgccagcagcattctaaatctctctctgaatctgaccctctgctgctcttgtcacatattcttctctgacccttctgcctccttcttaaaagaacctttgtgattacattgggtccacccagataatccaggaaaatcagcttcaagatctttaacttaatcacatctgcaaagttcctttagccacataaggtaacacattcataagttttggggactaggatttggccatctttgtggggccatacacaggcatactcatctggttctccattttttttaagctgaaggatttttttagttatttttacttttgcgaatgtgtgttactttcttttggtaatttcagattttcatttaccaagtttatttaaagcatagtataatatataatgatcaccaagatggtaagcagatattcattgttcaattagattcttgattttatcatcacttaatttatatcagtgtatcagctacttctgacatagtctgtaatagaaactgagaaacgttaaagcaacacagccttattaaatttctctttgtatcttttagactcgttataacaccagttctgtgggcgctttgttgaaacttgatctgtcattgtcttaccagtcattgaacttagggccactctaatccagtatgacctcat

SEQ ID NO: 14590 - DNA, 1247 bp, Homo sapiens
ttaaaattgttgcagaaatgttttctgtttattgcttataggtatagattaaaagaaataagataaagttttaaattatgtaaagatttagataaactacattctctatgtgtgtgaaatccgttgtttttcactgattatagtcagtggattagcaccaacttatctaggcaaacagcactaacagtttgttagtgagtatgcaaaaacctacttttgcttttaatactgtatattaccactcatactatttactcacataaacaaattggtgatgatacatagattttgaaataacactgattacttcatcctggaaaggttttccggttttttgttttttttttggcggggggggttgttttgtttttttagagttatagtaaatatcccattcatcacttaattggtttttggcttttggatattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaagtatgttctctatagtgtacatcgtagtgcatgtttcaaagcaaatgtgaaatttttaaacagaaaacatgtttagttaatatgctgtctttatgactaagaggagaaaattcatatcagccatttgtgctactcatatttaaaagattaagtctgtatttccctagaaaaatttagcaaaggaaaatgttatgtgcactactataagaacagtaagtcaagagaaatttatacaatcatagcatagtagggccttagtagagctagaaagaacttgagcaattatgttgcccatctttcacttcatagctgaagctcatttcatagatgaaagtgactttacgtaagttcctatagccattagtgtccaaaccataatcttttacatttgcatatcatt

SEQ ID NO: 14591 - DNA, 1087 bp, Homo sapiens
tctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagt

SEQ ID NO: 14592 - DNA, 1440 bp, Homo sapiens
gagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttat

SEQ ID NO: 14593 - DNA, 1884 bp, Homo sapiens
tacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatataggtcatactggtttcctttcattttttgattttctatttctaattttctgaattactgcatgccagttgttgcaaaccacttcaagtacttctatggaaagagatggatgttagtcaattagataaacttgccttttaattcaaataaggaagaaaatataaatgctgaaaatgaacattccacatgccagaaaagtggaatttttgtaggcaacacttgagtggggggagacgggccagtctatactacccattgaagtaaagactgctggatgaggccctctgttagagatagtggttctgaattagtaaaggggcaaatctcaattctaattatagatgttcacagggtgctgctataatcgatagcaggccaaatattcccagtttatgcttgttaacaaatggcatactaagcccagcgttgggaattagtcaggagttacgatgcctgtttagagaggagtgggggagggagagttacctaacgtaaggcacttcaaaggagtgcgttgggatcaccaggagtgcttaacaagacatagctgggccatacccccagtttgattcaggatgtttggaatggggcctaagaacttgcatatctaacaagttcaaaggtgaggctaatgctgctggtctggagaccacactttttgagaattactgccctaagatcacagtgaagctccttgagtggttgccttcagctctagcgattcctcccaacaactggacccttaatctgacaaagtatagcaacagataaaagacttcccctaggcataaaagatttcaatattaagccatccaatttcataatgctcatctcaactcctgacagcagacaaacttagccagacatgaacaaacaagtaattctaaagacagtgattatatttgaaggatcagttaatgttccctttgagactgtcattataaaaagcagtaacttcagcaaagatctaatttgaattttcaataagattaaaagactatgaaaagggaactttgagatgagagaaggttgatttcagatgaaaatatccagttttttaatatacagtggaagtgatcaataattagcaaataagatatttgaggacaactttacagattaccagggtaatgaaaaggaagtaatcaaagataagccccataaggatcaaatagcactgtaagtacagtaaaatgtttcttgattaaaatatggatcatgttgccacaggttaattacatgaaagaatgaatctcttgcagaggatgggagccagttgcacaatatctgaatatatgttatcccagggtttcttggaatctaaggaaaaaagcagagcaccagaaatgcaaaaagtaaattgcccatagttaaaggaacatctgagtagtcagatcattaaaatttatgaaacaattatttttcacaagtcatggtggctgaaatagagtgtataatttttttcctttcaaataagcgtattttcctcatattacactgacttaaaatttaaaaattactttgtaatgttgaaacctatagactgtggctcctgtaaaccccaggtcattttcctgccattcttacaactctgtctaagatctataaaagtatattc

SEQ ID NO: 14594 - DNA, 1104 bp, Homo sapiens
tctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactcgactaaaacaagtgtataactaaactaacaagattaaatatccagccagtacagtattttttaaggcaaat

SEQ ID NO: 14595 - DNA, 1108 bp, Homo sapiens
gtctttacaaggcaacgattgtctgtaggtgagaaaaactgccaagttaaggcaaagagggagaaagcaggactgcttccaaagagttctttcacgatgctcaaacatttcaattttttaggtcaaaaatgccttaggtttagcacagcaatgtaggtgccaaactcatcgcagtgaattgcaggcgggagcaacaaggacgcctgcctcctttctgcctgctttttgcaatagtccgatttgagaaggggacccacgagagacacaaaatgcacgcccccacgccacatcctttttaccccgcaatgggttaagactgtcaacaggcaggccacctcgcagcgtccgcggagttgcaggcccgcccccgccagggtgtggcgctgtccccctggcgctgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgggtggccgggggtcgccgccgctggtagggccacgggagccgccgctgccccagctgctggggaaggaagcagggagaggactcgggaaaggtggagtcggagacagacgggacaagcagcatattcagggatcaggctggcctcccggaaagcgtgggcatcggaggaccccgcgggggctgcccaggctgagggtcgcggggctggagggcagctgcggcgccgggcgctggcagctggaagggccagcgctgacgtatgtctgccccgcggcccggcgccctattcctgctgtcctgcgcggtgggcgcggacggcggggcccctgcgggcgggcgcgttgacggaggtacccggtcctacccgaccctccgtggagctccgcccggagagggcgcctctcg

SEQ ID NO: 14596 - DNA, 2884 bp, Homo sapiens
aaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgt

SEQ ID NO: 14597 - DNA, 2072 bp, Homo sapiens
taaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtg

SEQ ID NO: 14598 - DNA, 1224 bp, Homo sapiens
ccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccaccttagcctggttttctgctactgttatttatcatcgtaggttctgagttgctcattgtggttgctctttggaccaataaaaatggcaagtatgagatgaacatgataaaagtatgtttatataacaggaagaagctgggcgcggtgctcatacctgtaatcccagcactttgggaggctgagttgggtggatcacgaggtcaggagttcgagaccagcctgaccaacatggtgaaactaaaaattcaaaaattagctgggcgtggtggtgcgtgtctgtagtcccagctacttgggaggctgaggcaggagaatctcttgaccccgggaggcagaggtcgcagtgagctgagatcacaccactgcactccagcctgggtgaacagagcaagactctgtctggaaaaaacaaaaaacaaccaaaaaaaaaaaaaaaaaacccccaggaagaaatattgtcgagagtctctgcaaaaatgaaaatacctcaaacaattaagtttgttgctttaaagcaagattatagtgtagggcttgagatgtgaattcattagatatttaaaatccagcaattcttaagtttgtgctagaatca

SEQ ID NO: 14599 - DNA, 1222 bp, Homo sapiens
gttaatgaggaggtgctctggaatcagatgacctgggtttaaatcccagatttgccagttcagcagcatgatcttggaccctaactctgccgtggataaaataagggtaaaacctaacacacagggtttaggattaaatgagataatacagataaagcacttaggatagtacctggaatacagcaaatttcaaattataggttctttataatgatcataaaattatttttgtaattaaaacctctcttctacaacagaaagaggtcttaacagtttaacctcagggaaaatgatgacaacagtgttgttttctaatctccccataagaatacagagcaactaggatagccacagacactattacaacgctagatgacaaggtatctctatgaacttcaaaatacaactaagtgaggacaaaccactgaaccacatagtttcagtatctgtgggaggaagtagaaggaaggcagctggtttctgacagctctgcaaattggagaactacaacactgcccacagtttctcaactacaaagtgcagcgggccaatctaagaacagacactgaaactgggaagtgactacagaatctcatttgcagatgaatgttaaagcaatatgataaggtctgctgattgcattagagctgtctgggttttacgctgtgtacctcttgaagcttatgagacaaagcccagcactgaggacaaacttctagaattagaatccaaatgggcaggatgggtaaaataggacaaaggaaagaagatctagataagtattgggaagaaaggccaagacacagagacattatatatgtgtattttcatatatatatatattcttttaaatcactgtgaaaatgggagctctaaggctgtgaagtcatcctagagccactccttcctcctaaaagtacagaaaaactcatttcagttaaggggaaaaaaagagtaagtgagccaggattacagtccaactccagtcaaagttagtataagaaataagagaataaatagatcaacatcctcacagacaatgaaagcacaccggaaggacatgaccacaagacagataaaaacctaatatttgccaaaaaataaaatgcaaatatgacaggaaatttatattaattagtacagttatcaataaaagtaggaaaaggggaaaattaaccaagtaccaaacacttggagtaaaaagcaaaataaagcagaagga

SEQ ID NO: 14600 - DNA, 1383 bp, Homo sapiens
ttgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccaca

SEQ ID NO: 14601 - DNA, 1117 bp, Homo sapiens
ctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatatta

SEQ ID NO: 14602 - DNA, 1117 bp, Homo sapiens; identical to SEQ ID NO: 14601

SEQ ID NO: 14603 - DNA, 2916 bp, Homo sapiens
attcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacccagttgtatcagtgtttttcttaataatgtagtcagaggggacagtctggttcctgggcataattctccaaaaacaacagggaaataactataaatataggttaacatttattgaatgcctacct

SEQ ID NO: 14604 - DNA, 1128 bp, Homo sapiens
tggactaagcaagtcgcattctttcttaagagatgctgaaaactaactacttttcagtaacaaccaatagaagtatttctttcagcttgctgccttgttcattttatttctaaaaactgatagcacagtatcgatataaggctctatactgaatcccttttacaaatattaaattattggagtaaagtcagataagactacatataaagttctaccaagaggtgaaaaaacaagaagcatatttgcctcctatcaggagtatctgtgacttaatacttgtaagtaaacttctgcaaaaaaaaaaaaccaaaaaaacatttttttttcttttgaccaaggctcatcattgtatctctggcatcttatgtctttcttgagtaagtggattaatgaatggataaattttggttcatcatggggttggcttttaaaaaattatactctggcatttaagataaatttattatttatttgtaccattctaataactttggtgtcaaatagtttgcagtttaatctttgctgtttgaggttaagtagaaacctttgttttattagagcctcaaggtgtctcttttaaaggaattgttcccttcttagatttttgtccaagaatcctaaagagtggtagaaaaggaaaatacaatattcatcatcttccttggaactggccggtaacggtgtagcctgagaaaaatgtcctgttcattaatcggtggtagtcttggggatgcgtaaacagatctttgcacgatgctgatctgcaaaatcgaattggtcacagggagtccagagatttacattgttctacacatcatgtccaagtatactttcctctataatttatcccattagtaccacaacggattttaaaaaaagtttttttctttttatagagaaagggtctcactatgttgccaaggtttgtcttgaactcctgagctcaaatgatcttcctgccttggcttccgaaagtgctgggattccaggcacaagccactgtgcctggccctggaccatggatttttaacctagagagaaaactgtcttccagaacttttaagtgatttgttcaattaataatctgtctcttttcatagtaatgattgccttttagagtgagaattc

SEQ ID NO: 14605 - DNA, 1183 bp, Homo sapiens
taatagttattagagtacacatactagcaccactactagaaaacagctaaaattacatatattgtggttggacatgtagagaaaggacaagattaaaatacataagctcattcatgcctaagatgcttaaaggacagattttattaaacacttaggattattaatatgtgtctgatagaaacaggcatcctttgaaagagatagcctgtaacataggtaacttaatatacgtgtgtggatatttatgatacatgtggcatttatcttcttagtttcatctaagaataataaaagattgagtttgatttattgccttttttttttgtagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatcttt

SEQ ID NO: 14606 - DNA, 1371 bp, Homo sapiens
taatgtttcttttaaatttcatcttggtgtatatggttgtttcataaacttaaccttaaactgttctgcattagatatggttatgacatatacatacaacttagtacgaagcgattactattctaagtagcacagcaagaggttaagaacagagacccagggtcacctgcctgtgctcaagccttggctctgccacgtactagtggtgggccttgagcaaattgctacatctctaggccccagtttctctctttgtaaaatggagttaacaatagtatggtgtgataaggattagatgagttaatacatacagttttagagccataacgtgacataataataacaaaataaaggttcattaaataaaaacatttgtagcttttttgtccgacatctttgcaaggctgcggtgtctgctgctactctccgagcttcgcaatgccgcccaaggacgacgagaagaaggacgctggaaagtcagccaagaaaaacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaataaaaataaaaataaaaacgtttgtatatattctccacaaaaagcagaattttattgtacagaacactgggctaaaaatcagggtacacaggaggtggagaggagatgtgtgaggcgagagcagcccgcagtgagcagtggggaggagggaaagctctatcagcctgggcggcagagctcctccctgtgaggtcctgcctgggcccaccttcccacccacatccatgggcatctcagagatcctcgagggggcactccccagtagcatggaatcatagaatctgtgtgccataccagttgtttctgtccaatttgacagttcttctcaggaaaactatgatctgtgtgtctctcttgaatggaattgtttttctctgattgttcattcatctctgatcacttaaaaagtaattggaaaaagtaaaacatattaatatcatctatctccagtaactatatctggtgattcttttctactctccctacacgtctcactttattcaa

SEQ ID NO: 14607 - DNA, 1303 bp, Homo sapiens
gtccagagtaccaatgtttctggtaatctctggagttctgggtcagggtaaaatggtcatgtgtatgatgttgattgtacattaatttattctcaatgttgaggatgattgcactgtcatcttaatgtcatgcttttcctttgtagaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaacaattttcaagtcccttaacttgcaaccaaagaatgtaacaatggagggatcagcatttctcatcagcaccctcatctctactctgccttcaaattaaaactctcttccctctttgctgatatctgagaaaatgtagctttaagattttcaaaactctgtagttgagagcttttcttacatagaacatagaatcttaaatttataatatctagttgtccttagaatcttatacatcactagctgtaaatcagaattgccatttggattttgaagaaaaactgtgactttgcactgtatacccatagcctcatttttttattgttcatgttttaataacattaaaatgaaatttagtaatacttggtagtatttttaatcattaaaatttgtattgtacttgtaaaattgaaaagttaggaatttattatcctaaaagccaggagtttacatatttttgatttcagaagcagtatttcaggatttgtttttcatagagagaaaacaagttatacaaaaatgattttctgtatgtttgctaattgagtgtgttgataagcaattgactagataaatgatgtagtcttttcaactttgatacatcatcagagctataaaatattgaattcagctttctttgaattcatttttttatgacagtcttttttttaaccctaagtcaatggttctcattcatgagaattgcctagagaacttgtcaaaacatagatttttgcagccccacattcagaat

SEQ ID NO: 14608 - DNA, 1267 bp, Homo sapiens
tcttcacaaaacagactctgagaaccttttaaaatcagtactctttacccttataagtgaaattatccaattggatgtttttagaacgagtactattttttcggaagttcctaactcgatctgtgtgtaaattatttacagatgaatgcagttgcagccaaatcaccttatttaaatgcatcattactggacacttcaatggtttctccatttgaacactgaattttactttacttcaaatatactggcacaagcagtctacatcattcatgatttacctgttttactgtattaaagtaataattttacccatcttcaaagccatatgcattacattattgctaccatgagaatttatgtaaacaatgggtaattgttcctgtccatgtgaccttgtgctaataattattctaaaattgaaatttttttcttttcattgctattcattacttttttgtttttaaacaggcagctttcgattgccagatttaagagtgtgttcgttagcaaagctgccctagttgattgacataggtgtccaatggctttctctgtctttccttgatagtatttctatgaggaatttcattgtattactctgatgctgctgagaatttccctgcctgcttttgttactttggcctccactgtcacctgacttccatagcagatgtccactcaaaccctagtctttctacctacaatgccagtgaaaattttagcctcctttcactttcttcctcttccttcccctactggggaccctgactcttcagacacattagcatcactgactgaagatcttcctatttttgattattactctttacctcttctgttaatgtaaaaacttcacctttccagttatcaaggattcttctagaacccttctctcaacattttgaggtttgattttctatgcaaattcctcaaatagcttcccatctgaaaacgagagctaaaatcctaacaatggctttacatcatctgtcctaccacacccctctcacctctcctcttccaatctccctcttgcttactgtgcttcattaaaactctctccttgttcatgaagataccaagctcactttcttctcagggactttgtccttgctgatttctttacctggaatgttctgcttccagaacattcctcgtggtttatcctctcacatctttcaaatctttactcaagtgtcaccttatcagtgaggtcttccttgaccaccttatgaaattacagtccccttcatagcttctatgtaaa

SEQ ID NO: 14609 - DNA, 1371 bp, Homo sapiens
agtggtaattttattgctatgtgaatggatttaatattcatagttaccagtgctattttttcctttctatttgcatgtgtctgaataacacttgatatgagtttcgttcccttcactaacgtctttttttttttttgtctttgtaaatagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttaggattggttgaagtgtacattttttaattatatacattatagtatattttatgccatgaatgtatgtaaatgaatacatttacgtacatttgttaaaatgtatgtaatgaatacatttacatacatttgtttaaaaaaaacttgaattttttatgaatgaaatttctgtattgtttccaaaaagagagagattcaaacatgacttgcttcacatgaagaaatttgatttcagaaatgtcctatatttaaataagcaaagccattgaaattgaagcacatttcttatttgaagcatctgggaaatacaactgttaagtatctctcaaatattcagtatatggaatttatacccacatttgtttgtatatctatttgtaagctgttgct

SEQ ID NO: 14610 - DNA, 2061 bp, Homo sapiens
tgaaggttaacgttgttacgtatgaatatgatcctgtcattatgatgttagctggttattttgccccttagttgatgcagtttcttcatagcgtcgatggtcttcacaatttggtatgtttttgcagtggctggtacttgtttttcctttccgtatttagtgcttccttgaggagctcttgtaaggcaggcctggtggtgacaaaatctctcagcatttgcttatctgtaaaggattttattgctccttcacttatgaagcttagtttggctggagatgaaattctaggttaaaaattcttttattcccactggctgctctgaaaagccatctttgcattgttcctcgtccgcctccttgctcgcggcagcctccttgctcgcggcagcctccttgctcgcggcagcctccttgctcgccgcagccgcctccgccacgcgcctcctccgccgccgcggactccggcagctttatcgccagagtccctgaactctcgctttctttttaatcgcctgcatcggatcaccggcgtgccccaccatgtcagacgcagccgtagacaccagctccgaaatcaccaccaaggacttacaggagaagaaggaagttgtggaagaggcagaaaatggaagagacgcccctgctaacgggaatgctaatgaggaaaatggggagcaggaggctgacaatgaggtagatgaagaagaggaagaaggtggggaggaagaggaggaggaagaaggtgatggtgaggaagaggatggagatgaagatgaggaagctgagacagctacgggcaagcgggcagctgaagatgatgaggatgacgatgtcgataccaagaagcagaagaccgacgaggatgactagacagcaaaaaaggaaaagttaaactaaaaaaaaaggccgccttgacctattcaccctccacttcccgtctcagaatctaaacgtggtcaccttcgagtagagaggcccgcccgcccaccgtggacagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagagtcagccatttttaatgatctccgatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttcttttttttccttttttgtctatgaagttgctgtttattttttttggcctgtttgatgtatgtgtgaaacaatgttgtccaacaataaacaggaattttattttgctgagttgttctaacaaaaaaaaaaattcttttatttaagaatgttgaatattggcccccactctcttctggcttgtagagtttctgctgagagatctgctgttagtctgataggcttccctttgtgggtaacccaacctttctctctggctgcccttaacattttttccttcatttcaaccttggtgaatctgatgattatgtgtcttggggttgctcttctcaaggagtatctttgtggtgttctctgtatttcctgaatttgaatgttggcctgtcttgctaggttggggaagttctcctggataatatcctgaagagtgttttccaacttggttccattctccccatcactttcacgtacaccaatcaaacataggtttggtcttttcacatagtcccatatttcttggaggctttgttcgttccttttcattcttttttctgtaatcttgtcttcacgctttatttcattgagtttatcttcaatttctgatatcctttcttccgcttgatcgattt

SEQ ID NO: 14611 - DNA, 2061 bp, Homo sapiens; identical to SEQ ID NO: 14610

SEQ ID NO: 14612 - DNA, 2061 bp, Homo sapiens; identical to SEQ ID NO: 14610

SEQ ID NO: 14613 - DNA, 1229 bp, Homo sapiens
ggcggagccctaggtggaccgggggtcgggattggccagtttctgactagaagaggcgtttttatgttcacttgctgatacgcacgctgtggtaaaaaagtgaattctttaccacagtagcagctgccccgagcgaagtctcgcgatatttcggccgcagggatccagaggcgcgtagtgagtggcggaggactgtgggggtggcgggcaccggagccgggaagggacaggtcaggcggggagtgcgagcgcgtactgcttgcgccactcgggctgggtcaggagcggctgcccgaggtccagaggaagtgtgtggacagcgcggccttcctggccggtgagtcggccccgggtcgtggccggtgaggggaccctgagcttcacctgggctagcgcggggagtgacaggtgcgcgaaggagcgcggcgctccgccctctcgccgacccgccccctccgggcctcgccctccggggctcgggatgagtcgcgggccccagctgagcggctccggctccaggcgcctgtcgctgcttctgccgtcgccaccgaagagcggccgccgcccctgagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggtgagtgagggaggccctcgcgtcgcccgtggcccggcctttgcccgtcattctgggccgagcttggcccagaacgacgggcagaggcgcgaggtcttgtctccccaggggggtccttaccacccagaacccagcagacctggcccttgagaactaaggaagcaaaaccatgtcggtcagtgaggtactgtatggagcctgaactcaagttagaatattttgtaggatttttaaagtttttggtctgtctgccttgggccagggtgctttgccaaagtcgtttgttcaaaaatctttgttgagtaacgagttgggggcttttttataccattctataggttcaaattgtcaaatttaggaatagtggagattggtttcattttgtattctaagttaaggtcaagtatctttgtagttaaaaagtgggtgtctcaaaacaattaccaattgtttgccatcaacaactagccttgagaacagtgtttttcattta

SEQ ID NO: 14614 - DNA, 1652 bp, Homo sapiens
agatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtaaaactaaactccgtactgataacatttttacttactttcacagaaaataattttaaataatttttattaaaatgatgccattggctaggcacaggggcttatgcctgtaaattcagctctttgggaggctgaggcaggaggatcact

SEQ ID NO: 14615 - DNA, 1108 bp, Homo sapiens
caattatttaacaaaagtctggtatcatctaaaattctagtttctatcttctgaaacagaaattttcactatgctaggagaaggtctttaagtttaacctcatgttttcctttgaacttttggttgaacaaaagcaaagagattcataacgggtcatgatatatgcagcctacttaaatagttcaggaaaagtgtgtgtatgcgtgggtgtctacaaatatgaaagagaagtagaggcaaaacaaatgtgccaaaatgttaaaaagttgctgcatctgggtaaaaggtatatgaaagttctctgtattacttttacaatttttctaaagttcaaaggaaaaaaacgatacagaggatttaagaaagccagaaactacatgatcacttttcgaagaatacatttacctggttatgacatttttagtgagaggagtaacacgtattgtttgtaaccattccagacttggcagtgtcataacaaaacagccaatgattttgtcttcgttagttcctcctctctgatagctacagctggtctttcaactgacaataggtaagagatgatagctaaaattgaagtatgagaaagtatagctgaacttttttttattgtttctgtccttgtgtttgactaaagtttacttatggctttagatacagtatttttattctaaaaactattatttattggccatgttattccagccccacccccaaaagctgtggttgtaagaaagtgtcatctcctgccccagtatctgtctgcctcttttgatttctgttatataactgagttctgagatcaaggcccactgagtttgcttagcttatatatttatctgtaaggccacactttgcactagaaacaggattgtaagactatagattcttcagctcgtcttccgtagatatttcttacgtatgttggtccccccacacagtagaaacaagttttctttgtgcttaagaaaattcagcatctctcctgttaatgtatgtcagtccaactgttagagattcagtgaatacaaaaagaagtttccatattcagacttcatatattattatttgtaaacgcatgttaatctaaagttattcaaatttttaa

SEQ ID NO: 14616 - DNA, 1219 bp, Homo sapiens
tttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttttttagggggtatactat

SEQ ID NO: 14617 - DNA, 1175 bp, Homo sapiens
cttctcagcaatagaaaaggaataaattactgatacaagcagtagcttggatgagtcccaaaggcctgctatgtaaaagaagccagacacaagagtatatacactaatctattgtgacagaaatctcatcagtggttgtttgggacaaatgagaggagggtgagaaccaaagagtactagaacacttctggggataatggaaatgttctttgtcttgagtgaagttatagttacaggagtatacatatttgtcaaaatacatcaaaccgtatactttaaaagattatattttatagtatacaaattataccttactaaagtgaatttaaaataactgattacaattatgaaaatgaacttaaataaaaattctgcaattgatttcgagccaaatccacagatcaggaatataataggtgatatctttatatcataaataaattaagcctgatataaatgccaaaatttatatgatttctttccttggtgaaattaccatctttaatgtatttttcaaacctgagttaccttgaatttccatctccctttcttttttaaaacctagaatggtcagttggagtgcgtacgctggatggtgagcgaaacagaagccattgcagaactgagttgttctaaggattttccaagccttattcattacgcaggttgctatggccaggtatgaaggagttttttaagtatcttccctttgtgtaccatataatcttcctacttttttattattagtccatcaaaatccaaacataagaaatcatcaaaaatgtatccaaaggtatataaccaatgatatttgttgttatttttgttttaaatgaaaaaaagtttacaacaacctaaataaatatcccatgacagatattggataaataatgaagctgcagccattgatgacattttatgggaaaatgttcattatatagtactaaacaaatatgtatgatacaaaactggtcctataatttagcaccaactttgaattttggagataaagagaaatagaaattaatactaaaaaaattatgtcacaacatgtttatagtagttatcactcagagtagcagtacaagtggcttcgattttctatttttttaatttttcagtattttccaaattttttacagtaaacacatttaacatttatcaaaaggaacaat

SEQ ID NO: 14618 - DNA, 1261 bp, Homo sapiens
ttgtccaggttggagtgcagtggtgtgatcttggctcactgcaacctctgtctcctgggttcaagctattcttgtacctcagcctccccagtagctgggattacaggcaagcgccacattgccaggctaatttttgtatttttagtagagacggggtttcaccatgttgaccaggctagtcttgaactcctgacatcaggtgatccacccatctcagcctcccaaagtgctggaattataggtgtgagctacccagcccggcttatgtagatttttttttaatgctgtacaggatatatgcatataaatgacaaaaaggtaatgagaataacttatattttaattatcattcacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatatacacacacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtgaaatattagtaacaaattatttgggtatttaaacattaggaatcttttcaaagcatttttaataggaagaaatttttcttctagatgtatataggtgatgccatgattccttaattattttaattgacaaagctgaactcattaaatgactaaatgaagcttaagttttcttatgaaaccatcataaatcaaagaacatttgactcttgattgtcttgggtaaagaagagaataattgtctttgcttgtttttaaccatctctattacaagtgcccaatttaagaattaggaaaaaaatgtatttatatacttttacaagtcccatggattttgttcatcttctcgttatcttcagaatctcgtactttgcatatatttaatttattcttgtctttt

SEQ ID NO: 14619 - DNA, 1180 bp, Homo sapiens
ctggtcccaagcaatttggataaaggatattcagcctgtaataaccctaggaacacctgattggagatctgtccaaacttcctgagcactagttcaagatcctcctctctttccaactcagatataacttccatctgtaagagtaggtttataattacaggttgcagatttagagatactacttgggaactcaaatttaaatgatttttacctgaccctgaccatttactaccttcctggttgaactcagtccttcaaggtttatagtaatccattgagttgtggatgtctcaggattaaacattcagccacagttaagtacctactatgtggtaaagtcttaaatagacactggagacagaataacagctaagagtcaggtggaggatgtgtatatcaacaaatacaaataaaacaaccacaagcacttcaggtatatacagagagctctaagaccacagaacctgcaggtaaagtgttcctctgcattcttagggtgaccatacaacttggcatccaaactgaaatgtttttgaaagtacaaggtggtagtatagagatttgtgctgggataacagcagtagacctgggctgtctgggaacagccagggcagtggtcatctctccacttagcaccccatacctggctcactctgggttccaccatgctgccctcctgtctgtcattgtacaaacatcttacaagattgtatttaatagttgtcatgtgccttattaattgtgagtacagcatagtgggtctgatttgaatcaattttttgtttccaggtaggcctagaacagaaagtgtatgaagtgaaagtattttgaacttgacatgcataatctcatttacttctcagagcagttctttagggtttatgtactgttggtatttccttttgttttgagtggagttttgcccttttttgcccaggctagagtgcagcggtgcgatcttggctcactgcaacctccgcctcccaggttcaagtgattctcctgcctcagcctcctgagtagctagggttacaggcacataccaccattcctggttaattttgtatgtttagtagagatggggtttcaccatgttggccaggctggtcttgaacccctgacctcaggtgatccgcccgcctcggactcccaaagtgctgggattacaggcatgagccac

SEQ ID NO: 14620 - DNA, 1275 bp, Homo sapiens
aatcaataagctacaaatctggccgcacattcctgccgcgcctggtggtgtgctcaagtggctttaggctgaagcagcatgactgatagcacatcctcaaccaggcacatgcctggcgatgcagattcctgtgtttaccgtaagcattgccttgttccattctacagaatgcaattatattttgtttcacataagaaaagcagtttttcttttttttttctttttttttttctttttttcagattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcatttt

SEQ ID NO: 14621 - DNA, 1154 bp, Homo sapiens
aattgtcatcatcctctgtgtcctgatgggtcctgaagttgctgtgaccaacaacttccagatcagctgctattgctcttggtgctgaggcaagaaaaagcaccagctttagaatcagaaagtcagatgttcaaattctgctctgctattttcaagttttgtaacctctgtttcccattgtaaaataggacggagaatacctactcttcagggttgttatgagaattcggtgtgggtatatattgaatgcttggtgcatcctggttgggtgctgagtaacacccaatcctggataagtcacaggactgtcctgagctttgagcctcaggaaacaggtgcacagccactaggatggctcaaacaccttttcatctggctttaggatgttttcctgcccttcagttccttctcacttcagagcgaagtcatggacctgcttgatcaaggtttggcccttggtatgaggccagagagtatcccactatcctgtgccatatttaaggctttctttgttcattttaggccctagtgccctgttcccttaaggagttaattttattccctccttcatgtctgcttatgtttgaacatgtcttccccatccctacctcctatagggttctagtaattgattcctctaaggccttatgtttccctttgaagagctgacttttggaagacatctgttgactttcttccttgttttgtctcaggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatggtaaattgatacatttttttcctttcaaagctttatatttttattgagagtactttcagtgatttattttaatcttaaaatatgcttgttagagatccattatatagctgactggcctcttcaaaggtgaataaattatatatggtatggcattttaattcttagggtcattggcgcagcagctagggacttgacaaggagaaattaaggactaagttgatttattttactacttgatataaatgtaaagcccttt

SEQ ID NO: 14622 - DNA, 2230 bp, Homo sapiens
agagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctgagttcttgagcagcctgttacttctgtttctaaacagagtgggcatagtgttcgggttttcctatttcaaatgactgtctttttttctcaagtgtttacatactattttttgtcttacaactaggggagtctgaaatattaacactgttttgtagtccttttagcaatacccattccatttgtaagtggcatcgaatgtttttacactgattttgcctaggagttaatgagtatgaccacagtagataaatcagtgagtgggtgcaggcatgggtgggtgaataagtttcctagtaacaggaaaatatcaaatattttagggtaaaatcagatttacctttaaaatttctgtggtttttcatggagaaagtctagtttccatgtttaatgcgggcatgtactgcataggaggggtgtgtaatctaccaggtatatctaataccatgtctgtataaacataggagttcccttgcagataaatcctagtaatttctatctggacccgaattcctgttgcttcaagcagatgtgggggtttgagtgtgatttaaggacgtatta

SEQ ID NO: 14623 - DNA, 1174 bp, Homo sapiens
ggatagcatacagaaggactgtatgatatggcctctgcttatccagccccacctccctctgtatgtcggttctcactctgtgatctggcaccctatgcctgtgtcagttttctcacacatgctttctcttgcttctgtgtttttgtacatactgtcccttctgtctagaacactcttttttttactcccccattccctgttcagctgcccttttcttcttagccatatctagcttattcactttccagtttagattcactgtaaaacctatgttagatgccttttctatgtggtttattaccttaaggttttaaaaatgttactccagaattttacttttacatacagaaagacaatgctggttaagtaaggtttctttggtgagtatgtaagagagtaaaggaaaccttattagatattaactgtattcatgaaaattaccaagcaaattacaaaatataatcagttttaaaaatcttataatggtttatgacaaactacaatgtagtttaatcgtgtttttctctgtaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacaggtgagacttttcatgagattggtgacttacgaataatttgaaaactatgtaaaacattttacctttcaggtattaaaaagacttgcaagtagactttttttttttaacttttgaaaaatgagttcaaaacatgttttctttcatactggaaagaaaacttcttaatttagaaaaaatagattttgatgatcttgattgtaagagaataaatctctcaggatttaggagaatggccatcagttaacattgttttccattgtactgtgtggcattgtaaggactgacatggaaggatttttaaatttgtgaacgatttactttttggagaaacttacaatgtcaggaatactttctgccactaatacttaatgcctatagagttttgggttctattttatcttgtttataaactaataaattaagctgttactgtcatggatgctagcagaagacacaggttcttggatcagaaacaaaagaatttattaccct

SEQ ID NO: 14624 - DNA, 2352 bp, Homo sapiens
attccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaattaagggaaatagcatcatttttcctttttgagaatggaatcatactattatgttcacagaaattaagcattattccagttttaagtgaatgactttaaaatcattgtagatggggagcccatatttctaacagtatctcatagttcatcattgtgctaggtgctttaag

SEQ ID NO: 14625 - DNA, 1134 bp, Homo sapiens
acagtttggtatggattcatactctgcccttagtttctcccatcttgttcaaaaagttaatattggcatagagataagaagtgactccaggccaggcacagtggctcacgcctgattatgagacaagggcaattatagttgtatgataaatctcaaagaagaaactacaaaagtctcgtgtttcaagggacatttgattaactagataaggacattcctaaacttgtaaagttctagtataaatagctcaaaagtacaataattcttgtaagtttatgctctggtggagacagaaaggatattaggggttaataaaagggttctaagaaaccacgtgcttgaaaataattgcctgatttttgtttagaagccgaaacacaccatatccacttaaacaaaaatagcttaagagatttcccgctgagcttttaagaattagttccctaaacatctagcctggagttgcggattactgcagggctttgtctaatattaacaaatgaaatgttcattctcttctattataaaccaattttctgttcaaataaattttaaatgtgttcattccacttctttccttgtcatccctgcccataataatttttctcttttttcttacagacaggcagcaccatctggcctgaggtcacaagtacaattcaatgtggaggttctctgtcaagagcttacagctaacatagtgaaattagaaaaggtgacctatttctttcctgtgtatgggggcagtcacagtagtgcctgttggttgccctaggtcaggtcagggattacacactcagacgccgttagtgtgccgcaataaacctacatgatcaaccctggctaggggctttttatagtaaatgtggaagaatattttttatttccacaaagaaataggtcttaatctcattttccttgaaatacatagtcttgtaggtcttttgttcttcctccttgattagacatattacttaatagcacagggcccagtggtaagtgactactgacatcggagcttaatgtagggacatagtagggagtgaactggagaccaaccactggcttggccagaaagtacagccccaactccaccaaggctgactgttcccataggtaaaatattgcatgtaa

SEQ ID NO: 14626 - DNA, 1208 bp, Homo sapiens
tccacgcctgcagtggctcatgcctgtaatccaagcagttcaggaggctgaggcaggtggatcatttgaggtcaggagttcaagaccagcctggccaacatggtgaaaccccgtctctactaaaaatacaaaaattagccaggcgtggtggtgcacagctaatcaggaggctgaggcaggagaatcgcttgagcctgggaggcggaggttgcagtgagctgagattgtgccattgcactccagtctgggtgacagagtgagaccctgtctcaaaacaaaacaaacaaacaaacaaaaaccaccaccaacaaaaaaaaccatgtatggtatgtctttccagatttttatgtttctgtcttttttcttttaaataaaacgggatccatactaacattgtcttttatcttaaaggtttgtcttaaaaagttgtaacttggagatcttgccttgttaatatatacagatctgctacattttaaaagtgggcatgaaaatcttctgttatgtatgtactgtcattaattctgttattttttcccactagtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggg

SEQ ID NO: 14627 - DNA, 1141 bp, Homo sapiens
agccagggaggagacacaggagcatgtccctgagacacacatacacaatagtgttatgggatttgtattttactcaaggagttttttttgcttctgaaaggaagtgtttctatctggtttgaacgaatctataaactagtattttctgcttgttggtttacattctgtattggatttggtgggttagggatatgtgatgtttcttttcttacagacaccaccacagtcaagttgctattgcccagtcttcttattatcagtgttatcttagacattaaaggtttaatagatgaaatattgaagtaataagctttgggtaaaggcctaggtatattagcattcttaaagctcattatttaggaagtgactctaaaagtcacacagaattaccatcattcacaccatatcagcaaacttcatgatgcttttcctgtgtttcatctaccagttaccagcaggacttaggtttgaaatgccttgaggtgaatcatgcttccttttttgtttcagttctagataagactgactatgctttgcttcttcttttagcttgagaatgccagactgtcatcagagatgaatacttctactgtcaacagtgccagggaagaactgatggaaagccgcatgagaattgagagcctttcatcccagctttctaatctacagaaagaggtaaataatcatctttctgtaagaagttagacttgaaggctaccttcaccacgggcacctacctgctttgcttgggctgatgtcactcctccctctgtttgttacagaggatggtgtcatcctgtgctttcgtcttcacagtacttttctagattcgttcattttgcattgcataaacatcctgtgagcagatactattgttcctaattagtagattacacagagctaagggacttgcccttgaggaaggagcctgctagtttattcactgtacttaccctaggacccggatcttccgacctgtctaacagcttcatctctacagagttattctcaacaccttccttttttatatcatttgaaaaccaaaatgaagaaaaacatgcaaaaattctttgtgggtggtgaatgctttgtgtttctagacaaattctttagtgcttaaagtatataacaattaggatcc

SEQ ID NO: 14628 - DNA, 1264 bp, Homo sapiens
agaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttctttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttga

SEQ ID NO: 14629 - DNA, 1193 bp, Homo sapiens
ccgcactgcccgaggccctttgcggactggctggccgcgctcttcgcacggggcgcttttgcgtggggtcgcgcaggagccgcggagggccggatcgctgagggagcgtcagccgcgcgccgctgcgggaccgcgggtgggcgggctgaggggcggaggagcctccggccccgcctcccgcgtgctgctgccggagccgccgccgccgcagccccgccgaggctttaaacagcggggcccgccccgcgcccgccacactcgcgcgctcgctcggctgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctg

SEQ ID NO: 14630 - DNA, 1263 bp, Homo sapiens
agggaaaagggaattttgattatcatgtagattttgcactgtggtagcacagaacttgctgcatctcatttctgttaaaagaaaatatatataggctgggcacggtggctcacacctgtaatcctagcactttgagaggccaaggcgggcagatcacgaggtcaggagatcgagaccatcctggctaagatggtgaaaccccatctctactaaaaatacaaaaaattagccgggcttggtggtgggcgcctgtagtcccagctactcgggaggctgaggcaggagaatggcatgaacctgggaggcggagcttgcagtgagctgagatcgcgccactgcactgcagcctgggtgacagagcgagactccatctcaaaaaaaaaaaaaaaaagtgtacgcatatatatatgtgtgtgtatatacgtgtgtgtgtgtgtatatatatatatatggagagagagaattcactaaaggatgtgaagtactgaaaatatgttttaaaaatttagttggttcttctgcatttaaagaacatctgaaatatagccacattatgttctctgctgtttagatgtgggtagaggaagaaccacaggatggtgttagagacataattctaaacccagaacatctatttcctaaaccatctcccctttcctttcatgacctttttagggctcggttactgctttggaaatgtgtcatatattgggatagaacaaaactcaagaagcactgaaagagaaagagagaagttagagaacaaagaattatggaatcagctatgaaacctaaaaacctaaaaaggaaacactggttgtcaaattcattatgtcaaccagtacatgtctgagtctgagaaaaactacaaaggaaagcaatgaaaagcactgagtcactgcagacaaggaatgagtaaagagaggagctatgaaggaatcttgggatccatgggattcctgctgtcatggactataaaaaaaacatattcgttggtgatgaagaggagttttaagttgttaatgttgaaatttcagatgtaggactggtggcaactaggtgatgtaaatttgtggcttgagagatggggtctgaattgatcgacttagctaccctgtaattagcaaacaggagtcattgtttcctccagacactaccaaaagtgtagctagaatttggaattattaaaatggatttactgtcatagtgagacttaaattttaagaaatttcagtaattaaggttttcttctagtttattgtt

SEQ ID NO: 14631 - DNA, 1103 bp, Homo sapiens
actttttcttattttcctgtagcaatcacacactcaacattatgtttggaccatgtataaaacttgtgtttgtgtccagcatgttctccatgtcaagatggtagtgttaaggtggaagagacaggaatgaatgatctagaatgaaagcctatattgttttggaatttacagtgctttatggtttgtgggaaggcatgcacatctttaactcatttcagaaatatggcatgatctcacttttactatcttttttttccccagatatttctttaaagatctctttgttcattaaacaaggatttattgagcagctgcttggcatatggcattgtttaaggcactggggaatcaggcaaaacaagacagaaattctttccctcatggaagttatattctaggggaattgaatcaagatatagaaacaagatacttgattttaatttttaatgtttaaaattgcaggctcagattgttcttttggtgatcctacttcttgctattggtgatttcgtcataggaacatttatcccactggagagcaagaagccaaaagggttttttggttataaatgtaagtaaaaaagattcaatattttttaagggtacctatttatagaattctatcatcaattaaattttgtacatttcagatattttgtaacagaattgactatggtttggtgattcaccctaatttacaatttagttttgtcccctttatgctgtacagttggagtaaaaattacttctatttacatcttttctttttcattattagcaacaaaaggtgatagaatatggagaaatcagtgctgctaagaaaaggagattttattctctactagttttgggaatttgtaactgaatttctaacttttgttctaatatgactttcattcttttaacatatttaagcacaacagtataaaagcgcctaagattgtgaaagcaattattggtataattgcatttttcaagagtgcaggccatttgatttttaggagatctctccagttgggtttgtcttatttgtttttatagattcaggttatttatgtttgtcaggaacgtaagtgaaccgtgtctccttctcagtccagcac

SEQ ID NO: 14632 - DNA, 1258 bp, Homo sapiens
tttgataccaggagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaa

SEQ ID NO: 14633 - DNA, 1107 bp, Homo sapiens
gtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattcttatatctgtttaataagtctttgccagctttgtggttttatctcatttcgataactattgcttcattcatttctgaatttttaaaatagcttttaccttaatattcacgccctggaaaagtcgttcactattcttaaacctttgcaataatcactgttgatgctcacagtatgactgaaccatctgagatgcagctcattatggtatttttttaagtgacctagcttttctaattctgctttatctttgggccagatctctcatttgtgaatgaggaaactggaagattaaaagcgattcatagtccctgaatataatctgattctttccttccaaagatttttgtctaagctcatttagagttttagaaagcattttcattttctcatttgaatatgactgtaggtg

SEQ ID NO: 14634 - DNA, 1146 bp, Homo sapiens
aattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaatgtattgtgattgaaattattttgtcctccacaagatggctctatgagtattcttccagggattctaatattt

SEQ ID NO: 14635 - DNA, 2014 bp, Homo sapiens
tcatgggagttttcaaagaaggaaaatcctttgtacgtaggggcagatggattttactaaagggtgaaaggccttcttcattaagagcagattttttttatttttcctattggcagtggtaacaaatagcaacctggtgtgtttaaatacttttttccaaccatttgtgtgtcaaaaaagaagaatcaaagatttctgcacctttaaaaagtttttattaaatttaacctagtgcttctcaaactttaatatgaatgcaaattatttgaggatcttgttaaaatgctgatgctgactcagtaggtctgttgtgcagcctgaggtgacattttgcatttccaaggtgacatttcgcatttccaaaaattgggcattttccaccagtgctgttcagaaaggaccatatttgaaatagcgagaatttaactccagacaactgttttcctccactgcacccaaacctttcagggctcagtgaaataccagtacagtgaagccttttcacaggtgaaactaattctgtgacgtcagcttcgtttcccctgccttccataacaaactattataccacaaacagtgtcgtaaaacaacggcacaagtgtattctcgcagttctgtaggttagaattctgaaatgagtcttagtgggctaagatcaaggtatcagcagggccgtgttcttttccggaggctgtacggaagaaactgtttccttgctgctctgtgcttctagcattcacccatgttttttttttgttttttttttttttggttttttttttggcttttttgaccccatttctacctcttctaagccaatgaaggtgtatctgttttttcttatgtcacatctgtctgactcactcttctgtctttctcattctgacttaagagctcatgtgctttaaggtcatctgatcagaaccttattccatctgcaacctaagttttcttttgctgtgtaacaacatattcacaggttccagggtttacaacattaacatctctggtggccactctgtataacacagacaccgccatgtgatttagtattttatttcattttgtcatttgtcatatttccatctttcctgctatattataagctctctggaagcagagaccgtgaattatatatagtcattctggaaacattttgaaaacccactaagttctaaacattgtgctttgtgcttaggataaaaagatgcccctaggaaacttatgctatggcacaaaatcagatacaattctcagtaaatgtgaattgaattaaattatatcagaggtccaggaatgtcaatataatactaaagttcagaataactgtgaattctgccttctctctttttttgtacatcatgccaagcaggtcactgacaaggctttattattacaagaaaaccaaattgattataatacattatgccttaaaattggaagcatctgtaactttgtaggataatgaaattctttcaactgatgtaaatagagaacttgactacataagcaaaagagtagtcattgtgttgaattgcaagggtatgggagcaggagcaagaggattcacttattgaaatgctaaaacatctgtagaaacttattctaaaattaaaagtgataacttattccaatcaggaaacaaaatatcctgttacatccgttaaagtaatacatttctcaacgtggaatatattccctctctaaaagttgatgtttgtgtaaatatgactttagaactgggtggaactataaagatcatgatctcaaaggtccatttcagctcccaaattctaaaatggttttattttacagacacagttagtgaggcccagaaataaatgacttttccaaagttgcacagcaggatgagaactgaggttacttaattccctgtcctgttctttcttacattaagtgataatgctaaggattatcaaagagagaggaacaataaatatatacaaaagagtatgcattttataatttctgtaacaataattttgattggcaa

SEQ ID NO: 14636 - DNA, 1199 bp, Homo sapiens
tagactgcttttcagacatcagtaggattttccaaatatcaaggatataatttgctgcattgaagttgaatgaactgcaaattttatttacaggtttttcatatacagatatttcttgcctgatcagagactgatgtagagcttctgaagctgcccaaaatatatcccatttgatgtttcctaaagttcttttaagagaacctgagctcttcctgttctctatcatggcggatcaaggtgaaaaggagaaccccatgcagaaacttcacatctgcaagctctgcctcaacatctgtgtggaggagagtggagacagactaacccgagcagccaaggcattggagcagctcacagggcagagtcctgtgttttccagagctagatacaatcagatcctctggcatgcagagaaatgaaaagattgctgtccactgcacagttcaaggatccaaggcagaagaaatcctggagaaggatctaaaggtgcagaagtatgagttaagaaaaaataacttctcagatactagaaactttggttttgggatccaggaacacatcgatttgggtatcatatatgacccaagcattggtatctacggcctggacttctctgtggtgctgggtaggccaggtttcagcatcacagacaagaagcacaggacaggctgcactggggccaaacacagactcagcaaagaggagatgatgcgttgcttccagcataagtatgatgggatcatccttcctgacaaataaacccgtttccatcaaaaaggccaataaaaagtttttggtggaaaaaaaagagaaccagaaagctcagccttccttagactttatttgctgggcacagaaaatcatgcgcagccttgccaaccttctaaggaatcagagaaagcctcatcccactgactcatgacatttagaaataatctgccaatgtagacctggtttccggtttgaggcctgagtccactatcatggtcttgcatctgctgtattgactcagactatgtaaccacagttcagcctcgacttccctactagaaccttcagttccttacctgggggtgatgagaggatgggcaaaggggagtgctccctaggttctcattctccatctgtccactgggtcctgttgcaagggggtaaaccctgggaatcccattgtctttgccctccagactcctgatgttgct

SEQ ID NO: 14637 - DNA, 1144 bp, Homo sapiens
aatcctttatatccctttccgtagacctgcatttcaaagacttacattttaataagaattagttgtgcagctgcaaccctggcaacaaggcctaggagaaaagaattggggcagcattccagaaatcagggcaggcactggtctcatgtgggactgagctaatgaaacataaaaatataaagcatgtagtaaaaataagaccaatactttctttggcatggtagatactgacatttttccacacattttttttaaaaagtccaaaagctcataagctgcacattcaataagagtagctatattatcttctcctttagtataaaaaaataccccagatactcttggaagttaatatttctgtgaattatatccaaaatgtaattgttcttggcccactcttggtgaagtccagacgttttcaaaacatggggtacgaaatttgtcagataaagtttagaaacaaggttttaggttttaaactttaaaaatcaaatgctcatatcagttttaatgtaaatttctcatagttactggactctttagatgcccttaaataataaaatttgttaaatatattctctgaatactgtgacaatggctacataatctattatctaaccataatttaattattacctggttgttacgtgtttaggttgtgttggagttttccctcttataataagaaatattgcaagaaaacatttttgtgtgtataggtattttgctttcttttggactagtcaggattacttttggatttccagaagtgataatgatgcattaaatgtgaaaattttgaatactttctaaaagcactaccaatctacacagctactatagtgtgtatgcagttgctagtttctctgcttctttatcaacattgaatatttgaatagatatgaaatggtagttgaattttttaatttttcactttttaaattagaaacttggaatattttaaaagcagcttaccagcttcccctttgtggattttaaaatttgcgtccttttcccatttatctattggagatccattaagtggttttttttttttttgaagtagtagtcctaagaatctctcaaaattgagtgtggtaaacttcctattcattctgtacactcatagcaaatggtataatat

SEQ ID NO: 14638 - DNA, 1262 bp, Homo sapiens
tggtgatcattatttcttcttggaattagaaacttgtatgtggcagtcataatgttctaattagtgatttttaaaaattaactcattaaaataatccatacttttataatcataaaataggatgccccacgaaggcaaagatttctgtctgcttttactactacacctagaacttgacacttaaaaagttgctcaaaaaataatttgttgaatcaatatcagtttgttaaaatcttgattttttttcagtgtttactttttttggtaatatttattttaagaaataaaagctttcaaggataagtaaagtttaacttttttttactttttcttttttttccctagactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctgtaagtatgaagtatgtggacacatcaggtggggtgcttattaaactttccactggttctcaaactgaggattgggatcctagcagtaattgcaaagcagttgtagagaataccacagagaatagttcagtggaactccgaacatatgtttaaaaagaaataatgtttttaaagtaaatactgtatgtcaagaactctcctagaccattcatcgtacatgactgagaggaggtgttcttctgtcaaatagcttctggaggaatagtgagagaaaaaggagatagtaacctgaggtaaaacagataaatcagccttggaagtcagtgggtggaagatgtgacagccatattgccatcatattcctctcagcttaccatctcattttcctcagagcaaccctctgaggaagatatcattgtctttatttttcagttgaaacaggttcagttttttgcccaaagtcatatagcttgtcagtggtcttgactgacttcttggtatatgccttgtttttgtgccctctaatatatgcacatattgttacctctaccaaaatcctgccctccagcctccaaatt

SEQ ID NO: 14639 - DNA, 2001 bp, Homo sapiens
ataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaattttgtttagtttttcttttctttcaaggaaggaattatttaccagaattcagttagagcaccttttttgcattcttatattttcagtcatgattcctatcatgcaaaaaacaacttaaaactttttgatttaaaagagaatttaaatttctatcattgtaatctttaacttcacagttcacctcttaatttaacaaatacctagtcagaatgaaaattaaatggatagaaataggactaataaaacatttatgcctggtgcagtgactcacaactgtaatcccagctcttttggagatggaggtgggtggatagtttgagaccagcctggacaacatggtgaaaccctttctgtaagtttttattgcctatcaaccacatgatttttaacagaggtatcagatatctacacagctttccatgatgaagcatcttgtccttatagtatatgtaggacttaattaaaatgaa

SEQ ID NO: 14640 - DNA, 1161 bp, Homo sapiens
tttaatgtaaaagcaagtgaaattttaataaacttctgtaattaccaaaaaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctgcatatcccccttcattttaaaatcatgaatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgcc

SEQ ID NO: 14641 - DNA, 1790 bp, Homo sapiens
gttccacgtggctggggaagcctcacaatcatggcagaaagcaaggaggagcaagtcacatcttggatgacagcaggcaaagagagtttgtgcaggggaactcctctgtttaaaaccatcagatctcgtgagacttgttcactattgtgagaacagcatgagaaagactcacccccatgattcagttacctcccactggctccctcccatgacatgtgggaattgtgggagttacaattcaagatgagatttggttggggacacagccaaacctttcaagaagtatgtctgattttgatggatcttgaaacagtctgaccttaagtcttgtaggtttaaaaacctgatgatgtcagcagcccactaagtattggctcatcagaatgaaatctgaacaagatgcatttgatgactcagatttcttaatacattgaggaaagagagtttgatgcatccttcttacagaaggaaccagagtagatgaagtattctactttcaacttgagaggacccagaacattcaacatatgttggctaagactccttgtccctggaattatattcatgtatattcagttgaatctttcagtcctcagagcaagtctttttttttttttttttttggtcctcagtctcaagaggaccaaaaaatttattttatgaaaatatttcctgccatatctgtatctgttccatttctcccttttaaccagggattatacctcaggacattttgagataaatttgtaatttgttttgttttgttttgttttcctctaaaggctaacagtgtccataatgctaagaaggtgatgctggacaaacagtataattacttgagcccccaaaatcttccatcctgcccccactgcagtcatcacacacatacaaaaaagccacagtaatatatattccctaattctttttttcttttttgagactgggtcttactctgttgcccagagtggagtgcagtggcatgatctcagctcactgcagcttcaacctcccaggctcaagtgatgctcccacttccacctcccgagtagctggaactacaagaatgtgccaccacacccagctaatttttaaaaattttttgtagagatggggtcttgctatatatccaggctggtctcgaactcctgggctcaagtgatcttccagccttggcctcccaaagtcctgggattacaggtgtgagtcatacccagcctgtattcctaatttttttaaaaaggaaacttttgcaacagtaatttattgtcatagggaaaatttttagcatttgttcatgctataaagtcacttttcacttaaatttaattatattaaatattagcttatcatgttgaacattggtccagagttctataatgacaaaaagaaataagatagaacaagggggggtggaatattattatttacatgtgcttatcatataaacattgtctcaaattagaatttttctactaatagcagaaatcacaagggcaaagactaagatttcaccaggtgaacatttaaaatgttcttgtgttacaaataaataaaatatggaaactaacattttccacttcatagttggactaagtgttgttatctactacaatacagcaggaaaaaaacataagggataccaaaaaatatttttaaaaagacataatggttcattaaaccattatcagttactgagtcttaccagtaaccaaagaaatgaaaaaataatgatatttttttggagggaggaaaagaatagggcttatgaaatgggaaagcaaaacaaaaca

SEQ ID NO: 14642 - DNA, 1204 bp, Homo sapiens
tttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcac

SEQ ID NO: 14643 - DNA, 1213 bp, Homo sapiens
gattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtaagtaggaagttttcacctataatgggccctatataaatatgtaccattctcttttttagctgttctctgaaggttagtataaaagagatcattgttctggatagctctcttgttttcatattctcttaactcataagaaggagtaaaggctaagctccagaaacaccctggaaaggttttatgaagacctcaaataaaagttaaaggatctggttgataagtataagatttcttactgcttagaaggtttcaagccatttaggagtgacttatgccccccaaaggacatatgctgagcctggcagttagggagcactaatccctgagatgttagaatagctgttagaaatagatttggccaagactaagaggaaaacagagaatgtatactttgggtcaagtatgcaaggagaatattcatgcttgagaaacattacatacctagctttggacttgtgaggcatttaattgttttgtt

SEQ ID NO: 14644 - DNA, 1201 bp, Homo sapiens
cctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaa

SEQ ID NO: 14645 - DNA, 1375 bp, Homo sapiens
gataattatttttttctgttgttagctgcttatgaaacttttattgtatttttttaaagttatgctactcctggccgggcatggtggctcacgcctgtaatcccagcactttgggaggccgaggcacgtggatcacttgatgtcaggagttcgagaccagcctggctaacatggtgaaaccctgtctccagtacaaatacaataattagctgggtgtggtggcgcacacctgtaatcccagctacttgggaggctgaggcaggagaatcacttgaacctgggaggcggaggttgcagtgagctgagatggcatcactgcactccagcctgggtgacagggtgacactccacctcaaaaaataaaaataaaataaaaataaagttatgctactcctaaaccacttaatatatgttttgtggttttcaaaattatgtaatcagccctgaaacacattggttgaaaatattttgagactttataagttagtatttattaaattaatattattttaataagttttgttaaatcctagtttaaatgacaaagctgtgtatagagtaggggtgagtgaaggtggagtactcttgaggtggcgataaaaatgtacccataaatttaaagtccattctgtaattggaatactgaatgtcctgtgtgtggtgaacattttctaggtgattagaattgcatttcactggctgcatttgtttgtggtatgtaagatagctagaaatttattacttaactctgtggggcattgtttagatactgtgaagagttgaggtaaatatgtgtcttgtaaaagctttgtgtgatcagaatattttggtaattataaaatgtttttgatgatacacatttaactctgttagtaattactctaaagaaatcttaattttaccagtttaaaaaaaacgcttctttttaaaagttcatgtttctaacctttaacaattcagttaataggaaaggagtaacttttaaatcaagctttaaaacatggaaatttaagccagtatgttagatattttttctatcccaccctaccatgataataaaaataaatctataaaaagtcaaaataaaaagccgatctataaaaagtcaattgagaagttctaaaagcaggctactatagcaggggtgtttgttttttgtttggagacggagtctggctctattacctaggctggagtgcagtgggacaatctcggctcactgtaacctctgtctcttcagcctcctgagttgctggaactacagctgtatgccatcatgctcggctaatttttgtatttttttgtagagatggggttttgccatgttgcccgggcctgtcttgaactcctagagcttaagtgatccacccgcctc

SEQ ID NO: 14646 - DNA, 2289 bp, Homo sapiens
taagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgagtttttgtggtgtcttttttgggcagtagcttttctgatttaacgtttcctgagcccattaatctgctacaactgtggtaaaatacagcttgtctgttctttgaattttgtggaggttgatctacttctgtaggaattgttttaataggaaaccctgctacagacatctgtgaaaggctcttgcataggtgggggatggagggaagagtcacaggaaagttacaggaaggtaaaggggcagcctgtggtccatgaatctttattggttaactgggtgcaggacatgagaaaaggggcacctgcccttgaggagtgttcctc

SEQ ID NO: 14647 - DNA, 1008 bp, Homo sapiens
gtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcat

SEQ ID NO: 14648 - DNA, 2013 bp, Homo sapiens
tgagctactggccaaggccaaatgaaacctcgtgctcctctgctgtggggcggcccggcctcggggctcagaggcgctctgtctacagctgggaagactcgcaggccccaagctcctggccagcgctgccccggaggtcggcaggccccttcctcgtcacctttttgttccctcccccgcctcccgcattcggccgcttcctgactgggattccacagaaaagccgagggctgaggagaagtgtgagcgcctccgcctgtccactgtcccccaaagtcagttcaatccccgacgtcctccgctaggctccaccccaccggcccgggcagggcctccaaggcacctcccacctacgggtcacccagtcagcccacttctttctgggacaaaggcgtcatcccttagagacagtaggaaaatggtatctcccggaagttacctcacgacctccaagagcggcttccaaccttgccggaaatgacgaacgagtcaaccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctggagtgcagtggtgtgatctcggctcactgccatctgtgcctcctgggttcaaacgattctcctgtctcagcctccgagtagctgggattacaggtgcaggacaccacacctggctaattttttgtatttttagtagagacagg

SEQ ID NO: 14649 - DNA, 1173 bp, Homo sapiens
aaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatata

SEQ ID NO: 14650 - DNA, 2806 bp, Homo sapiens
tttggttttctagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcgtctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtac

SEQ ID NO: 14651 - DNA, 1766 bp, Homo sapiens
ctggtctggaactcctgacatcaggtgatctgtccgtcttggcctcccaaagtgctgggattacaggtgtgagccactgcacctggcctttcaaaatactttgtgtatttaaaagacagtcttgctatgttacccatgctggagtgcagttgctcttcacaggtgaaatcatagtgcactggagcctcaaaatcttggaattgagcaaacctgcctcagctgcccagagtagctgggagtacaggcacgtgccactgtgctcggattatattttactatggttatttttaggcacttttcaatgattttttttttcactacagaaatgatatatttggagtttgcttcaaggtattaacgttaagatatgaggtaaagcctccctttgaaaagcccctttccattcgaagtttggaaaattagttcagaattatattttatttctgattatgctcattttataattttattttattttatttttttgtagactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgtaagtcacacatttagagcttttaacattgtgactacgtgaagcaattgactgatcatgaaattacgattgaacttgaacactgcttccttgccttaatagtaaggaatgtaaaagttgaaagatgaaaaaaatgtaaagacagacttgtgagttactcccaagtggatgcgtagatctgttaactcgtcctcttgggaaatggagaaaatgtcattcacagttttcaaatacttagatgacaagtcagttatagaataaaagaatgactaattgatatcttagatttctgcattttgattttatagaacaatatacctttgttgttgtttaaaaacaaaattaacttttctatgcttagattgatactaatgaatgagatgcaggtgatggtttatggttatgataaatgggacttttgggtctgtggaaatagtaatattgtatactttgaatgctatgatccttttctctggttata

SEQ ID NO: 14652 - DNA, 1184 bp, Homo sapiens
tcatctccaagtatcgtgtttggttgaaagctaaaataggctatgcgtggtggctcatgcctgtaatcccagcactttgggaggccgaggcaggaggattccttgaagccaggagttttgagaccagcatcggcaacaaagcaagaaccctgtctctgcaagaaaaaaataaattagctaggtatggtgacatgtgcttttgctccccgctacttgggaggctgaggcaggaggattgcttaaacccaggaggttaagtctccagtgagctgtgatcatgccacggcgctccagagagagagaatgacagagagagagaccctgcctccaaaataataataataataaaaaaagaagctaaaagtgaccttcaaggtattacttcgaaaactagctttttttttttttcaatcccctcttgagataatgttgcattgataatgggaagcattgttcattttagcttttaggactaggacatgaagaaagaaatataataagtctaggcccctttgttgttttcttgcaggtgacatatatggaggaagagcgaaattttaccactgagcaagtgactgccatgcttttgtccaaactgaaggagacagccgaaagtgttcttaagaagcctgtagttgactgtgttgtttcggtgagtttgatccctatacattattgggaatttgcatgaagaagcagagagaagaaagctgctaatttcaagtaaacttgtttttttgtctcaggttgtaatggttatttaaaatgtttgtcaggccgggtgcagtggctcacgcctgtaatcccagcactttgggaggccaaggtgggtggatcacctgaggtcaggagttcgagaccagcctggccaacatggtaaaaccccgtctctactaaaaatacaaaaattagttgggcgtggtgatgggcacctgtaatcccagctattcgggaggctgaggcaggagaatcacttcaacccgggaggctgaggttgcggtgagccgagatcatgccattgcacttcggcctgggtgacaagagcaaaactctgtttcaaagaaaaaaaaaatttatgaaactagtcttcattttcttactctcttctgctgcttagcttttgctcaggcctcctttgttattctgcctatttaaatctcttctgtttttcaaggtgcattcat

SEQ ID NO: 14653 - DNA, 1308 bp, Homo sapiens
gagctaaggctttaaggaatcctttggtagtaaactgcagagagttgagcctttggtattactcagttttgtgatactgagtagactagaagtatgtacatgacatgttagtatattttaccttggacatgtaactgctattggttgtcagactggtgtagtggggagggcatggactttggaattaaggagatttggctttgaattccacttctaccacttagtagctttgtgaactgcagtttatctcatctgtctaggtctgtagcattatctgtaaattggggattatagtgcctatttttacagtgtggggtaataaggattaaatgatgtatacattgctttgttttaaccttaatgtaaccctccctctttttttttagataaacaacttaccaggtaaatatatatcatctgtttcaaaatcgattggttaattgttagattaattctcattttttccttaaggttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaataggtaagtatattactatttcgatgttaaagtgaagagtgagttttctccacatatattaacctttaattggctaattgttaaaataatcacggaggttatatgataattttggttctattttaaaaattagaagccattcaggaccctgctttttatgtaaagttgggtctggttaataatgtagactaatgtttttgttctgataaattgaatattccaacatgttgatagttctttacatatgcatttgttatacacgagatttcagtttccaaaaaatcagggcaaagggctgtaatgcagaattaaattgaatttaatttacccagtgactaagaaattgtaattttttttttgagatggaggtttttgctgttttgcccaggctggagtaaagtggcacaatctcaactcactgcaacctccacccccaggttcaagcgattctcctgcctcagcctcctgagtagctggggttataggtgcctgccaccacgcccagctaatttttgtatttttagtagggacggtgtttcgccatgttggccaggctggtctcaaactcctgacctcaggtgatccacccacctca

SEQ ID NO: 14654 - DNA, 2684 bp, Homo sapiens
gagggcggatttgggtttagcatggcttgtaaaatttgttaattttataagaaaccagttttctgtcttacccattccaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaaaaaattttttttttttttttttttttttttttttttttttttggtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttgaatggtttccttaattccataatgaaggctgctgggtgtgtgtgtgggggtgtgtgtgtatgtgtgtgtgtctgtgtgtatgtgtgtgtggggtgggggcggggggtgtgttttcaataaaaatgttctctaggagtaggaaccctctgagctaaatttcacttaacatccgttgaagacttccagtctgaagagtgacagctgaagcacactgcctactttgtgagaaaatgttgcctaatttttctgtactcaaactctccagttgagtcttggcccagttcctttggtgttaggaatccttgtcttgctcctgtgactgggccttactttgagggttttgttagcagaaggcgggggttatggcataaaggtaagtgctaggactt

SEQ ID NO: 14655 - DNA, 1149 bp, Homo sapiens
gtaatggtgaggtttgggcttctagtgtacccattacccaaatagtgaccattgtatggaacgtgggaatttgttgtagatcaacaaataactgtcgtgacctggcccgcaaagccaaaagaaggtacttttttttttttattctggcagtttttgtggttttcacattcattccattttctgcatgatgggtggtccaggggaaccatgccagtaggcccccagttcagcagcgggtaatagaggagaatgggtcaggtctcagttttagttttccttgtgcttcttattttcaaattcacctgcattcaaccacataagtgtttttaaagtaatcttagtagtccctttgaaattatgtgtgcagtaattgttggaagaaagaagttttgggtttgaattaccgctgtgtcagctttagctcagtgctttttctctgtactgccctggagccaggatggaagggagatgctttcctgtccagactgaagagttacagggaggaaggaagctgtctgctgacaacaaattccccataagatttctttacatagcaggctcctttactcccatctgtactttaaatatctatttgaattgtagagttagccttggcccccccacattcagggtcttgcctcttgcagaaaggcaagtatagtgtttaggagtgaagtgaagccaagtgagtgctatggtgcaggctgtgactcttctctctcctttgaaggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcaggtaatggctgctgtgaaaagatgtggatttattaattcgcatctgccagcctgccttgtgactaaatctagtggcaaatttcttttctgttcagcttgcacgtggactgaagctgaccttcgattcatccttctcacctaacactgggtaagagtttcatctgttttctccacaaggatgttctctgatgttgcaggtggtggaagccctttgtgacaaaatgttttgggggctgacagcacctaaaatatggtctccgagacctg

SEQ ID NO: 14656 - DNA, 2413 bp, Homo sapiens
ctagtaaaagatgaaattaactacaaagtaaacagaagaatgagaatattaaagggcagaaatcaatgaaatagaaaacaggtaaacaataaagtcaatgaaaccaaaacctgttttttaaaatgagatcaatatagtgctataactgcttacgtttgaactctttaagtgtggacaaatatttttgccaagacctgatgtggtatttgtgtgcatgtgtacacacatacacaacagtagtggccgttatttcacatttgagctagtatagtttggttaaggaagcagaaggattcaacattatagaggtataacaaagaaggtcacataaaagtctttcacagaagaacttaggagtgatttattcttctccctttaatttcttaaaattagcattttaagctttattagatacggagtgtcaatcattaactttggatttagtttaaaacatcaagtatactttaaggaaaacaactgtctctttacaggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaat

SEQ ID NO: 14657 - DNA, 2472 bp, Homo sapiens
tttttgagacggagtctcactctgtcacccaggctggagtgcagtggtgcgatcttggctgactgcaagctctgcctcccgggttcacaccattctcctgcctcagcctcccgagtagctgggattacaggcgtctgccaccacgcccggctaatttttttgtatttttttagtagatatggggtttcaccgtggtagccaggatggtcttgatctcctgacctcgtgatccgcccgcctcagcctcccaaagtgctgggattacaggcgtgagccactgcgcccggccaaccatgttttgttttgttttgtttgaaatttcagtcaaggtaaaaaccatgtttttataaaagcatagtctctgtggctgaagttgccttgactctttcaaggggagtacagttaacagaccattatcattaaggttctgttacattaagacaagccaaaattgaataggaagtgtaaagtttggaagactcatgttcttgatcttgattgtcactacatggaggtcgtggaacataaaccatgaatcggtcttgtttttcagcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtga

SEQ ID NO: 14658 - DNA, 1516 bp, Homo sapiens
tttttttttgagataaggtcttactcttttgcccagtctggagtgcagtggcgcaatctcggctcactgcaacctccacctcccaggttcaagcagttctcctgcatcagtctccctagtagctgggattacaggtacccaccaccatgcccagctgttttgtatttttagtagagatgggatttcaccatgttggccaggctagtctcgaactcctgaccttcagtgatccacccacctcagcctcccaaagtgctgggattacaggcttgagccagcgcgcctggccaagacattatttttattttcattgcttgaaagcttcctattcatgttacatactgttgttcctctttgtcttggaaagagtaattattattcagttttggatgtagctgacaacatttgcccctcaaatgagattggtgagatgaaaaccctagataatttcccttgtattcttagtataaatcatgatccagagactgagctctaaagtattctaataaagtataactgactttttatattgtttattgcaacttataaaatgcctcttttcagcagggcaaggtggctcacacgcctgtaatcctagcactttggaaggccacggcaggcggatcacgaggtcaggagaccaagaccaatcctggctaacacggtgaagccccgtctctacttaaaaatacaaaaaattagccgggcgtggtggcacacacctgtagtctcagctactggggaggctgagacaggagaattgcttgaacctgggaggcggaggttgcagtgaaccaagattgtgccactgcactccagcctgggcgacagagggagaccccattccccccggccccaaaaaagcctcttttcatcctcttggcttccacagtcaaatgtcatgcatgtgtgtatttgtttcatggtctcctaggcaggaagctgtaatgcagttagtttggagttgacttcatgaggaaacagaaaaggtgaacattcccactattcagaaacacaggttccccaaccctccctacgttctccactgggaccagaattgtatgttttcagaaaattggctgtaaggctaagttgaagctcatgtactgtagaaagaatgaaggacccttcaggagtatgtgggataacatttgtattaccagtctggtgtggccctgttttatggcagcaaatatgttccctatctcatggtaagtcaggtttgtcagagttacctgtgagatagcctttgcttagtttggaaggggtaagttaggaaaactaagagactgggtttggtggggtcttttatcagggtactgaggagagaggcaaagctatatgtaacagggagacactatttattctttctgctttgacccatttctcttacttcattatcatccttgcctgagaaagctgtcaacctccactcatacacaggcagatctgaattggatgagaaccatgaaggaggaagatttttgtttttgtgggctttttttttttttttttt

SEQ ID NO: 14659 - DNA, 1174 bp, Homo sapiens
taatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtc

SEQ ID NO: 14660 - DNA, 2082 bp, Homo sapiens
ccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcagtgttttctgtgctggctggtgtgaggctccattgcattggatggggtagggaaccctgggagtcccacacacacacccgacaatgggctcagcaaaaccacggggtccctgagttttccaagggatcagctgccacctcctaaggaatcataataaagatgttcagtgcacaccaagggctataatttcagagcagtatttatatttttcattattattattattattattatttgagacaggatttcactctgtcacccaggctgcaatcttgattcactgcagccttgacatcccgcgctcaagctgtcttcccacctcagccttccgtgtagctgtgactacaggtgcatgccaccatgcctggctgattttggtaattt

SEQ ID NO: 14661 - DNA, 1203 bp, Homo sapiens
aattctgctgggatgtggggctttattaattttataaaattccaacgaaatgtctctcttctattctaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctg

SEQ ID NO: 14662 - DNA, 1178 bp, Homo sapiens
tgactgggttgaagtttggttttataattatctgaagtcccaaatcatgaatagatttatttatttatttatttatttatttatttatttattttttgagacagagtctcactttgtcgcccaggctggagtacaatggcatgatctcagctcaccaccgcaacttctgcttcctgggttccagtgattctcctgcctcagcttcccaagtagctgggattacaggcatgcgccaccacacctggctaatttttgtattttcagtagagacggggtttcaccgtgttggccaggctggtgtcaaactccttacctcaggtgatccgcccacctcggcctcccaaagtgctgggactacaggtgtgagccaccgtgcccggccatgaatagatttaaaatagcttttttaaaactgaaaataggtttagaacttcaagcttaattgggccaaatttaaattcatttggataattagtatcagatatcactttgaccaatcatagctcttgctttgcaggattatataagaaaactggtaaactggtatttcttggattggataatgcaggaaaaacaacattgctacacatgctaaaagatgacagacttggacaacatgtcccaacattacatcccagtaagtatattcctacatacaatgtgatacttgatcaaatgatgctgagtcatatgcactaaccaaaagtgttttgtttcagacagggtctttctctgttgcccaggctgcaatgcagtggtatgatcacagttcactgcaacctctgtctcctgggcttaagccatcctcccgtctcccaagtagctgggaccacaggcatgtgccaccatgcccagttaatttttatattttttcagagaccaggtttcgatatgtttcccagggtggtcttgaactcctgagctcaagtgatcagcctctctcagcctccgaaagtattgggattacaggcgtgagccactgcacctggccaagttttttgtttggggggcattttctggtagataaattatgatcaggtgatttgacctgttcctaaaataataaattataggtgacctcgctcccagggagaatatttagatcttgaattagtactcatacctttttatcagctagtactcccttctctagcttgaggaattaaaaagtttttgtc

SEQ ID NO: 14663 - DNA, 1206 bp, Homo sapiens
acttaaatgagtatatctgtaggacacattctttgatatgggattgctaaagtcaaaataagtatctagaattttgatagatactgccaaattatcgtccaaaaatgttttttgtgtttctttttgagacagagtcttgctctgtcgcccaggctggagtgcagtggcgcaatcttagctcactgcaacctctgcctcccgggttcaagcaattctcctgcctcaacctcctgagtagctgggattgcaggcgcctgccaccatgttcggctaatttttgtgtttttggtagagacagggtttcaccatgttattggccaggctgatctcaaactgacctcaggcgatccacccaccttggcctcccaaagtgctgggattacaggcgtgagctaccgcacctgacccaaaaatgttttttgaaaattagtatccccaccttcatttcaaaagccatctgttattccttaacctcactaagtactgtgtattatctagatttctttactttttgccaatctgataagtaactaggataaaatgtaaatatcagtatgtaggtatataaaaataattttgttacctttttctcttctaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggtaaattgtttgtttttttttggatttcaaatgttcaaatattgtctggatttcaaatgtcaaaatgggctataaaatacatgtagcatatcttatgtgtgctaacttaaaattgctgtttttatttatttatttatttatttatttatttatgtagagacagagtctcactctgtcaccaggctggagtgcagtggcgcagtctctgctcactgcaacctctgcctcctgggttcaagtgattctcctgcctcagccacccgagtaattgggagtacaggtgtgcgccaccacatccagctaatttttgtaattttagtagagatggagttttgccatgctggccaggatggtgtgaatctcttgacctcgtgatctgcccgcctctgcctcccaacgtgctgggattacaggcatgagccactgcgcccagc

SEQ ID NO: 14664 - DNA, 1126 bp, Homo sapiens
gtgattaatgctgcagtgatcatggaagtgcagacatctctttgatatactgatttcaattcctttggatatatattcagaaatggaatttctggatcaactatttctcttaattccaccataagcttttcccttaaacaacttgaaatttacataatcaaccaagtattctcagagaaagcctctagaagtaactgtttatatagtaaatgttattagggttatgaggaaatcaaaagccttctgacaagtctattttactgctacattttatctaaatttttttgccttttattcctaagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactg

SEQ ID NO: 14665 - DNA, 1099 bp, Homo sapiens
agtttctgtcaccaaaagtggtgagtggtgaatggtgagctgatatatagaaatgtcacataccagatgggcatggtgactcatgcctgtaatcccagtattttgggagaccatggtaggaggatcacttgaggccaggagctggagactagcttgggcaatatagtgagacccctgtctctacaaaggaaaaagaaatgttacatatctattttatttcttggttactaggatatgaaattaagagccagagagaacagatgatcatttgccctcatttgcaagcctgttaaaccctgaaagtttacaatttttatcatttacaattaaaatcaacatcttcctagcccttggtaaagatatagcaagatattgtcattcattcactacaaataaaatgaatatttctgtccaggggatccatttgcattttcacttcattaacttgatacaatatggtgttttcagattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggtaattattcacttgattcacacataaaatatctattaagtacttgccaagcattgtgctgtgttctcgatgatacttactttgttctctataattcagaactaaattttatgtcagtttttactctaaagtgctttgtgggagtaagattattattgtctcatctaagagaaagaagatcatacaggcatactttggtttgaccaagttccatcgccatttatcaactatggaggaattgaatttaacttttctctgtgttataccctttccattgtacgtgctatctgtaggttttcatgattcactttaaagagcttttattgaaatttcaaagtaacgttttaatttcttgtgatattgctatcacatgcatgtaatagcaatatcacagtatgtggaactagaacacaaaacacagaccgggcatggtagctcacgcctgtaatcctagcacttggagaggct

SEQ ID NO: 14666 - DNA, 1127 bp, Homo sapiens
tcactccccctgagaattattgactatatttttagtaggccactgaccttgagttatagtccttcttccagcctgtttcattgcagtataatttggtctcaaggcctgagccctggggtaagtcagctgcatcctattggctattctgtcttgaaagcacatgtttcctcatttattgaacagggatgaagtttctggtcctctcaggagtctgatgacgtggttcatgcaatgttgtttctctgttttctatttttctccctaccatagacaactgattttttaaatgaaatgtgacttttaacaaataggtggtatattttcccatggatctgtgtagtaggatttgtgtaaatataactatctgattccagccttttggtggaaacattccttatttatttctgtagaataacttaatttggtatttctaattcagttttttactagtcctttttttccttttgatctagattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtattaagtaatttgttccaagtctcagtcaatacttttaagaagttctttgattttacttttcaggaattatgttgaacacaagtaaacaagttgtcctagacattgagtttgtgagaatttaacattctcaatacagaattttttgataattgcatttggatgatttctcagtgctattgactgaggactttgggcctattctggaatttctaactgttagccactggtagttttatagggtagtattctgatgagtcttaacaaaatcttaaagatgtattaataattctctttttctttctttatctgcttttattgggcacacaactccctggatatacaaacacccagttacatgactcaaatcaatatggtcttaaacagtggagaaatgtgatttttaaatatttcacgttatctttttcttggaagcttacttgttattttgaagcttttgaggcagtcattaactataac

SEQ ID NO: 14667 - DNA, 1121 bp, Homo sapiens
tatgtatttgtgtgtgtgtatttatatatatttgtcttttatttttggtagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgc

SEQ ID NO: 14668 - DNA, 1188 bp, Homo sapiens
gtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtc

SEQ ID NO: 14669 - DNA, 1171 bp, Homo sapiens
gaggacagtcacatccaccagcccccaaccctcagcaatgagtactcattctaggtcctgatagctgccttactttggcccccagatcacaagtccctttaaaggaaagctgatctcctcgtccactgtggcttgtgcttccttttgtcccaggtgccacccacgggctctgaacattcatcctagtttgcttgctcccgcatcccgagcagcatttgagtcttatgtttgaaatgggttcatttgagccagcaactccctgcttcccttttgtgcctcgtgcacttggagtgtccactgtcctttacctgtatcccaaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggcttta

SEQ ID NO: 14670 - DNA, 1134 bp, Homo sapiens
taaactggtcatcagatagcaccagccagggaatcaggcagaagtcaagccttggtggtggaaggtgaacaacctagccggcagcctgcttgtcctggggggcactaacggtagagcctcaggtctgattcagggctctacaggggattgttttcagactgtactgatgggtgcactgggtttcttcactgaaccaccagatgactcttccagctaattgtttgtttgttttaaccatgggcaatatattttcagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattctttgtattttgtatgcatttttcaaaagaaaaagtagcactagttgtcatcttaaggtctggggatttgaaagtttttgttttaaaatattttttgttcctttaaaaatttcgactcagcagtgaagacaactgcctgggtctactttcacccctgtaacatattccttgggtaatgtattgaaagttaacgtgacccatccacattacttccatttgaaatacagagcagttcagcccttggggtcaccttctccctcttttccccactctgcccttaggcactcccaccctggcctctcccctgcctatgttcttgttacctcctgccagccactccaaaggcagcctcagatcagaattcctcatacctcccttgctggatgaactaaaatatttccaaagtagcagcaa

SEQ ID NO: 14671 - DNA, 2131 bp, Homo sapiens
cacaaaccatcaacaaacctcaccctatccccatgtgaaaactaccctcctagatcataaatataggcttgctccttaccacctggcaaaagcccaaggtgattttagtagagtgcctctttctcttgttgaggaataaatatttaaactgcaaattgagtgattaacgttctggtaagggaagccagagaaaggaattggttcgtttgagaagctactattagaaaaatttgctggccttctattgaaattttaggttgttcaaacattagaataagagactaaacataggtaaacatggggtgatgattttacataagtctttctggatgctcagttctacagtttcttaaatgtctcccagctgactctgacctaacaggttttctgctgctcagaacaaagctgggcgagtgtccaatacatggaaatttatgggtttgtaggacaatataaaattataacagtctttctggagctgacagaattgcttgctaacttttatttcccccaaactgagatatgaaaataatctaccacttagtagattccatttcatagaagaaagggcatttttttttattatactttaagttctagggtacatgtgcacaatgtgcaggtgtgttacatatgtatacatgtgcacaatgtgcaggtgtgttacgtatgtatacatgtgccatgttggtttgctgcacccattaactcgtcatttacattaggtatttctcctaatgctatccttcccccagccccacaccctcccacaggccctggtgtgtgatgttccccgccctgtgtctaagtgttctcattattcaattcccacctatgagtgagaacatgcggtgtttggttttctgtccttgtgatagtttgctgagaatgatggtttccagtttcatccatgtccctacaaaggccatctgacaaagggctaatatccagaatctacaaagaacttaaatttacaagaaaaaatcaaccccatcaaaaagtgggcaaaggatatgaacagacacttctcaaatgaagacatttatgcagccaacagacacatgaaaaaatgctcatcatcactggtcatcagagaaatgcaaatcaaaaccacaatgagataccatctcacaccagttagaatggtgatcattaaaaagtcaggaaacaacaggtgctgaagaggatgtggagaaataatgcttttacactgttggtgagagtgtaaactagttcaaccattgtggaagacagtgtggcgattcctcaaggatctagaactagaaataccatttgacccagccatcccattactgggtatatacccaaagggttataaatcatgctactataaagacacatgcacacatatgtttattgcagcactattcacaatagcagactcggaaccaacccaaatttccatcaatgatagactggattaagaaaatatggcacatatacaccatggaatactatgcagccataagaaagggcattttaataccaaaacattaggaagagacatgatttcagacaataggctttatgaaaaacttgggcatagttgctatgatttgaatgtgttaacacctcacaagcaactgtaacgaccttaagcacctgccctgttgtcccgttgggtgggtaccttgaagggaaaaggcagaagttttttgccaagtgggcaggctatataggaccaggcagtgatggcttgtctctggagtgctttactactttctaaggccagtcgtttaatcaggaactctccagtcttagtctcattttctttctttctttttttttttgtatttttggtagcagtggggttttgctgtgttgcccaggctggcatcctcctgccttggccccccacaaagtgttgggattacaggcatgagccaccactcccagacccagtcttattttccaaataaggaatctaaggcttagggaaagggagcagttttcgggtcatgctgttgggggagccaggacccaaatacagaacttcagagttcaaacttcagagtactatcacttttatgtcctgtgactgtttttaacagttggaaaatttacattattttctccttatttctcttttgcttgccccacaaactttcat

SEQ ID NO: 14672 - DNA, 1772 bp, Homo sapiens
gtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttgga

SEQ ID NO: 14673 - DNA, 1648 bp, Homo sapiens
aatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtggatgtttttacacattgaggtaatacatagtcaaatcctttgctctcaaatagttgtacactttccatacatttctgtcttattttttaattctagtgatacacaaattaca

SEQ ID NO: 14674 - DNA, 1323 bp, Homo sapiens
aaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtac

SEQ ID NO: 14675 - DNA, 1849 bp, Homo sapiens
ctgggattacagcacccaccaccacgcctagctaattttttttttttttttttttttttttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttattcaatgcaggagttgctctcatcctttgagaccataagaattttcttagttgagtcttcaagtagctattgcttcttatttatgtgctttcttcttacttcattttgtgtacctctttatatgttaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccaggtgcgtccctgagcagccactagatctaaaatttcattttgagctttagttagagaaaaatgaccaagagcatcagctccgattcagatgcttcttctctgttctacatagacatgtgccatctttatccttagaaataaatatccttagaaatagatgtgagaagaggtgggtgggcatttatgtattgcaggaagaggctaagtatacagatatgagcaggcttgaaaatatgttctcacctttctagataaaactggggagaagaaaacataggcacatgttgatgactctttctgaccttaagtgtttggatatttgacatctgtctgtagcgcttatgtgatctcaaggtggtcgctttgtacccaataagcttctgagatgcttttctctttctgttactcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtaactattcagcgaagccccagagaatctcatgggtcctacataggcttctcttttcagcctcactttggtgctgctgctgcttttttttttttttttttggagacagagtcttgctctttcatccaggctgaagtgcagtggcacgatcttggcttactgttacctctgcctcccagcctcaagtaattcttgtgcctcagcctcctgagtagctgggactacaggcacatgccaccacgcctcactaattttttgtatttttagtagagatgagttttaccatgttggccaggctggtctcaaactcctggcctcaagtgatccacccacctcggcctcccaaagtgctgagattacaggcatgagccaccatactcggctgctttgcttcttacagtaagaattacttaaacaactctcctacttctgcccatctccatctttgtagccctttggtgctaacatactagtcatctcctcaggtctacccatgttactggtttgcacaggacaggtgcc

SEQ ID NO: 14676 - DNA, 2132 bp, Homo sapiens
ccagatctcaactggattcatgtgcaagatgctgaggaggcctggaagctcctaaaagtgggtcgtaagaaccagagctttgccagcacccacctcaaccagaactccagccgcaggtgagtagattgtaagaataaactcttcactgtgttccaggaaacattagtcctctgcctggtcatggaaaatgtgcaatgactttttgtttttcttaacttccagtcacagcatcttctcaatcaggatcctacaccttcagggggaaggagatatagtccccaagatcagcgagtaagtttatccatttagaaatttgggcttcttggccataaatgatagttgggaaagcatggaggaggtcctcaggggaactatgtgttctccttctttgggtacagagattcttagtgggccgtcccctctccagaattatacaaagggccagaaggctcataacatgtgaggcccttatgtcagatcctgtgcatcattctaggctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtgagcttttgactataattcctgggctctgcaatttgctaagagacttcctggacaccactggggatggtgctaggatacccaaagggctggtgttctgctcacagctctattatctctgattctctgccaggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccaggtgagaagctagaggtgtgatgggtgtgcgcacttggaactggtaactctaagaaagctcctagggactacttatggagtcaagtaagatattttttttccctctagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggtgagaatacaagaaagctttagtgtagcagcttagtagctacacatttttccatggtgccttccaggtgggcttgtgccttctgagggcatgagcatctgatgacctctgacatgtgtgtctctcctaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcaggtactagctgagtgacccctcttgctctgtcacctgagacagagggtgggaagtaaggagttaggtggagttgtgcctcaagatctgttccccaagttcactcctcagaaccttcacttacctctcttttctcctctgtttctgacagtgaacatttggacacccaaaaggaactattggaggaaatgtatgaagaaaaactaaatatcctcaaggagtcactgacaagtttttaccaagaagagattcaggtgagttgccctgagccagctccaattagctgctcagatttccatcactagcttgcctgaagtaaagagattttataaactactccagtaagggcaggaatatataactcccttttctctattccccatagtgctttgggttcaatctatgtttggtgaattgattaagggtttagttggccaggaaatcgtattaagtgctaacaacaggttttcaagggatcagtgtcacaagtgctttgtttgttcagtcatctgtcttagcaatatttttctggctctgcaaagaattgtgctctctgcttccctcttaggagcgggatgaaaagattgaagagctagaagctctcttgcaggaagccagacaacagtcagtggcccatcagcaatcagggtctga

SEQ ID NO: 14677 - DNA, 1093 bp, Homo sapiens
gggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctgtggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacatt

SEQ ID NO: 14678 - DNA, 1255 bp, Homo sapiens
gtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagcaaccttgtgtactacagtgtcttcttcccttccccacaaagacaaggaagaagcagggtagaaggccacctaactgttccagccccttcatctaagatgtgggtcaacctttcaaaaaggggcagtatttggaccctaggccctttgccggccatggcaggatgttatactgtggcccaggcttctgctaaggcctt

SEQ ID NO: 14679 - DNA, 1582 bp, Homo sapiens
gtgacgaccaattggataacaaccaagggaattgcaggatgaatgacatcctgctatctctggttcaccttgctaaagatgccctcagtgtagtctgtggcagatttcttccccactgctggtgaactccagttacaagagcagatccatggaattgtaaaagagaaaagttgatggacccccaagaaatgttgatctggtgatagtgaggtccaagaaagagatcattagattgtcatgagaagccagcatcactaattcaggctatcttcctttcagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaaggtgatcctgctggggctatatttgggctttgctctggcactgggctcaaatgcc

SEQ ID NO: 14680 - DNA, 1263 bp, Homo sapiens
tttctttgcatttgtctcatccctttttacttcactttggcccatcctctttacttcagaggggttactgggaactggtatccattcccacatagcagacatttgtagacttgatgaagcagagagaatcacccctcagtttgctcctctctgaaacctacataaggattttaacagctctatcaaaatccattaacttgtgtggtgtgaggttatggtccagaagcgggtaaaacaaagtctcatggtaaaagcagctgttctcaataggaattgctatgttgtgggagctcaagaggtcctgatgaacagaatagccatatcgtgagagactagaggcaggtgatggctacattctggcttcttatgtttttcacatccatattcaaagttgttttgccatagtggggcacttcccacaagttctgcatggttcttagctcccaatggaagcttctttgctccttgctttcccttcctgtcaaggatggacataatgggtacatgcccaagcagggaaaggagtagcaacccaggtcagaacaaatgtctgtccccaaaagaatcatgctattggttcctgtttacacctcatgacaaacttttcttctctcccccttgccacagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggtacccaaactcctgttttcctcctttgctagttttcattagtgacacataacttccactctttctctgagtctataaacatgtttcatcatcttggtctttgctttcctcaactcctttgctctcagcgtctgtgaagaggctctggcatagtagtcacttagttgtttggattgtaaaatgacatgtgattttgtccttggagaattaaaattgagcagtgttagctgcagctctgtgctattccctgagtaattcctaacttgggttggttctatttgaaaccactattataagcagaaggactgcatttcatattatggatctacctgactgcttattcctcctcagtgctagagtaacttgagtcatgttaaaaagacggggaggtaagatttggagataatgtgaagcatctttgaaatagatataac

SEQ ID NO: 14681 - DNA, 1169 bp, Homo sapiens
taggtagtacttttctaggcaaatgttttaaggccacacaagttttttgatagtgtgataacactccctagtttaaaaactttagcaggtgcttgaggaaggggagctcatggcattgtcattttcaatatgaggaagtgttctcaaagttggacttgtcagatttttgtcctttcaccttaaaacaatggtaggtattagggcaacagaagtgatttccccagggtgagaatgaagcataacaatggagtagaagcatttcctttcactttagttgacatgtggaaatccatggattatacaactaggaaagaacagtagagcttcctggagaagaggaggccctcctcaggaaaccctcctattctgtctcagccctagagctggaagtttttcctagattgctctgattgggatatttttgtttccacagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcagtaagtagctttcatatctagttcagtgatagcagactggaaaataagcatctatacgcccagctctgcccttgaataataaattatattctggggcataatgggacttgaaaaaataaatgaataaaaaattaaaaacagacagccgggcgtggttgctcgctcctgtaatttcagtctttttggaggctgatgtgtggatcacttggggtcaggagttcaagaccagcctggccaacttagcgaaaccccacctctactaaaaatacaaaaattagctgggtatggtggtgtgtgcctataatcccagctactcaggaggctgaggcaggacagtcacttgaacccaggaggcagaggttgcagtgagccaagatggcaccactgctctccagcctcggtgatggagtgagactgtctcaaaaataaataaataaataaatccaaattatacccacttggtgggggaacattctgccctggtgccaactgtgtagcttacatggcaatcacatgactcccagagcatgcctggacttaatcatgtgattccatgggctatgc

SEQ ID NO: 14682 - DNA, 1866 bp, Homo sapiens
actaaaccagtaggcttacagtcaaggtagaacgtacatttgcatggggctgctgtgaactgactttgctgtacaccttctctaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctgtttggagtggactaaattattcgtgtaccaacccttctaaaatcaacatcagattgggagttgggttggaggtgggggattcatttccaggtcttcatgactgtgctacacccagatatttttctttgcttgttgagactgtgccatgttagaaaaaaggaaagtgccagggtgaggtcagtatggtttggggaattgggggtaaggggaaggggccacatgaattagagggtagaaagagagacatgtttccccatactttatgctttgtgaatggagtgggaaagttggggtcctcccttcctgtggcagagtctggggggaagggtcatggtgtgtggcctcagcaaagttggacagtctgtggtgggat

SEQ ID NO: 14683 - DNA, 1099 bp, Homo sapiens
aggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttc

SEQ ID NO: 14684 - DNA, 2302 bp, Homo sapiens
atcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaatatactttgtgtg

SEQ ID NO: 14685 - DNA, 1666 bp, Homo sapiens
gccatttgtggaatttagagtgagattagagttgggagatagtctcctgccgtcttgactctactttggcattggagttagtgtcaaagggaaggaatccagaaaccaccagtagggtagaaagtggggagggggagtggaatagaaatgaatgatgaggacatatgtgggtccctcatcttggagtgcaacaaagagcaaatggttagctctaacgttaaatctgagtggctctcaaatgttttcttaacagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttccctatttctgcttttctgtcctcagtgtactggcttgtcccaaattctctgatgtagttctaataattatcatgtgctgacaacctgagcagaaaggcaactacatctttattcaatgttaagatttcccaaaagtcttccagcacatttcccttatgtttcatggatgaatgtcatatgccat

SEQ ID NO: 14686 - DNA, 1123 bp, Homo sapiens
cacaagggaagaccatgccccatgttagcaatgcaaattattgctacagctgcctatgataatttggtctttagttgataatatacaagagaatgtggacttctaagtccccttgccttgcatcctctgtttcaaatgatttaatgtgttgtgtaggaaagcagataataaaacttaggagaatccttcccagatttacaagggtcatgaaggagatacttctataggtataaagtgtatgagtgttagaagatcattagcaggaacccaagtacgaaatggttatttgaataaacattctcagatttgagttagcctgtcttgagatctggctgggagcgtaggacacgtgctcccttttgttctgctcaggtagttcccaagtgtgggccgacaggttctttttccttgatgttcaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtggtgagaatcctgtgttttgttttttgtttttttgttaccagaaaagttcttacatgttagctggtagtgatgattataagaaggacatcagtagtctcctccacaggattaacataatttgctaaaagggatctcagtcatttgagactgaatttcctgtagtcttctgttctcaaagacagtaaaaagggtagtctggaccagacttaggggagtgttcttatcttatggatgaatgaagggggtggtatgagggtgccgagataccaagcagggctacttggacatggcttgttcttgaagtaggaattatttctggctgggcaccgtgg

SEQ ID NO: 14687 - DNA, 1218 bp, Homo sapiens
ttgggacctttactaattgctgagatttgtgtgaataaactgtcaaaagacttcagaagcaaattatcttaaaatgttttgcaaagtttgaaaacagtggcagtgtgatctccagataaagctaagttcattgttaacctctttctggaacatcttggtgacatatagtagagacatctaacttgtctctaatcattttttaatttgtaaaatcaaactaaaaacctaatgatcatatttgagaaattaaaatatgtgttaaataattctctgtacacattaagaaagctgaattattttggaaattaaatatagcatcattgctgtatatcttaaatatggggaattgtatgttaatgttcagtggaatctcatgtgattttttaaaagaataacttaatcttgctgtctttaaagatattagtttgtcattttaattgactccagtttaatgttaaaaatgaaacttttaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtaggtcattactgctttttaggtaaagagaggcaggcctttctagaaaatcagtgtttgaagattttttttgtggtcagtattctcattcttatgcttgccaattgctcagtaacttacttagttattggagatgtattaagttggactggctcatattttaattctcattcttatgcttgccagttgctcagtaacttagttattggagatgtattaagttggactggctcattttaatcatgagagatgcttgcagagggacatctggagaatctgaatccacttctcttgggtatttcaagtaatagttaagtcttagaaatgttgtaacacaaattgataggaaagaaatgggaccgaagtttacttttcatcctgtgtaatacttctttttagttcatgctgaagagatgggtgtgataaaatggaaaaatatctacctactctgaaaatactctagaaattgtcctattgtgtcagaatagtatgttaaatcagccatgcatatttgaactggttggagcttgacataaatctgggtataaa

SEQ ID NO: 14688 - DNA, 1157 bp, Homo sapiens
ctgttatggctgtacacatcatgtagttgggatgattaatgaagtgtggtggttctgcataattgtggccctgtttctgtattctatggatgtgagagtagattttattagatatgttttttctcctgttcaaatcttgaatttttcttttttttggatacatataatgcccttttttttttaaaggaacattattagatcaaagggaaatatttttaagcctcttgatatatagtgccaagtcactttccagatattttgctttcaccagcaatatatgaaggtgctttttttagtgatagctataaaacaaacaaaggaacagcaaacaacaacaaaaatgaaaactcttaaactaaatttgtgcatgaaatatacaaagtttggattatttttatatttttaaaaatgtagatcagttatttgagttcattcttgctgagtttgtttttcattctgtaaaacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtaagtatacaggcctatgtctgtaatttgttctatcacaggaagattgctactggccttccttagttcagtattccttaggatttagtttggttttgaatttggtttatctcaatggaccagagatgtttttgtttaatttccacttactcctctattccaagtatatatcatcctggctctgttctgagccagtgttgtcttggctgtaatgaagaacttgtagcaaagatactgttttgactccttccctttttccagtaatgattaaatattttccttgtagagttctggagttgagaaaccaagatacattaaattttgtacttttatttatttatttattttttccatttaaccctgagtggacacagcacatgtttcagagagcacagggttgggggtaaggtcacagatcaacaggatcccaaggccgaagaatttttcttagtacagaacaaaatgaagtttcccatgtctacttctttctacacagacacggcaaccatccgatttctcaatc

SEQ ID NO: 14689 - DNA, 1101 bp, Homo sapiens
tgggaggccagggcaggcagatcacctgaggtcaggagttcaagaccagcctgaccaacatggtgaaaccccgtctctactaaaaatacaaaaattagccgggcatggtggcatgttgcctctaatcccagccacttgggaggctgaggcaggtgaatctcttgaacccgggaggcggaggttgcattgattccaagatcacgccactgcactccagcctgggtgacagagcgagactctgtctcaaaggaaaaaaaaaaacaatcatgtcttacaaagaaatagtgaattgactcagtgatagcaattgagccccacacacagtgaaaccagcccaggcctgctgtgggccaggcagcccagcgtgtgcaccagtgaagcagaggctcgagacaaatgctgagtgattttgactttattcaccatactgttcagaacactgcacattaaaatccagaattctgggcctccgtgcacctggccaagaggctcagggtggctgggggctggtggcccagagatgtgtctgacctgtgatctttgtctgggtggcagacccctgaggagttggatgactctgactttgagacagaagattttgatgtcagaagcaggacgagcgtccagacagaagacgatcagctgatagctggccagagtgcccgggtaaggaagcgctccgtggggcagttcagcttgtgctgccgactttccctgtcccctttcttgtttccaggaaaacaccctcagtattcagaacaccgtttctctctctctgtctctctggcagtagactgaagttaaactaagttgtggcacctgctagtcaaatgtagcctcctcagctagaggcagaccaggtcctgggcctcctctgcagtgccctgagctttagtttatgatagagccctgggtcagggaagggctaagatttagtcaatgcagtgtttgttgaaaggatcgtgaaatttgaaaaagattgctgcctttgtccatctcgatactatgggtatgaactatttaattattcatgggtttaaaaaataacagtggtacattcaagaaagccagtcagagccattgcattcatttgagtcatta

SEQ ID NO: 14690 - DNA, 1651 bp, Homo sapiens
gtccacgaggctggaggtcaggccggtgcttcttaccacccctgtctgcctcgtaggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacatccaagagcccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgatt

SEQ ID NO: 14691 - DNA, 1181 bp, Homo sapiens
tgaatgaatgaaaaggagagttttgagcagggtcttctttttctcctgttgcccccttcctctgtcctcagtctatttgttcatttcttcattcattcaacatatattttttctttctaggctggtgtgggggccaatggttgggaatggggtaaagggaaggtttccattgagttgaggctgggaggcatagtcagatctctccttcttcttcaatacctattttgtcctttattttggaaaatgttcaaggtattatcaataccagcatcctcctcctgaaaattgctgccttctacctgctttcaccaaatggttttccttatgccaagggagggtggcagagggagtagggatgaagcctcttcaactcaggggctgtgtaggtatgtctccgtgcactgtgagtggtggggctgtggggagccaagcttgccttgcctgggatataattcccataattgaaggcttggctttgggctaggctcccaaagtgttgacatttccggaggactcacgccagcaccagaccttccccgcagcccacgttctagcttgttactgctattgaataggctccctgagtgcctctcttcaaccgaagaagaaagtggcttttattgagagcctttaggaggggttcaggagactggatattgggtattccagaaaccctgagttgagcaaatgagagattcgtcaaagccatgtgcctttggcttcctcattttgctgctctgcttgggtctggcttgattgacagcttgcgacggttgctcctacctgagaagtggggagtggctataataatttgggcatgagaacaggagcatagggggagggacatatttagtagataaaattgacaatagttgatgatggctgagtaggggatagaagacagggaagggagaggagggattgagagctcttgggtttccagcgtgtgcagtagaactaggcagtcctggaggaggatgagacgtgtggagggaagagcaggagctgagctttggacttcttaagtgtggaacatacaagaggagagtacagcaggcatatcacccagaagagatggcaggaagactacctaaaatctcaggctgcttttctgttgaagttatccgctggggtttaggccactatgggtagataatacagtccaaatcaaattctgttta

SEQ ID NO: 14692 - DNA, 1112 bp, Homo sapiens
acttgagcccaggaagtggaggctgcagtgagccatgattgtgccactgcactccagcctgggtggcagagaaagaccctgtaatataatacctccattctacaaatgagactgaggtatagagaggtttctcgcccagtatcatttggctagacactggttaggggatagagccaggctccctgatatttgtttaatcgactcttttgctactattgaactgctgtggtgtataagtaacaagagatgaaaacaaagctaaacaaggataagctattggttttattgtctgctattgtttctgtggcttaggcctaagttaccgtgttttgaggggagggactctgagctgcacacgtgttcactgttggctgactaacctggagttgtttcattgcagagaggctggctgtggcagatgcaactgcaggtgagtgcaaccccttcagctctcttggctccagctgtaggcagctgcctaggttgtcttgtacctaggcaagtgttacactgctgggagaacagcagccaatagctggttggcattctggccctggttcatgccaactcttgtgttgactaccccaggatgccagcatagttgcttatccattaaggcaggcgtgttttttggcttccctgggccacattggaaggataagaattgtcttgggccatacataaaatatagtaacactaacgataactgatagctaaatttaaaaaaaaattgccaaaaataactcctcataatgtgttaagaaagtttaccaatttgtgttgggctgcgggttggaaaagcttgcattaaggtttaatctgtgagagcatgactttttgcagagaataagtccagaccttcctgaatagttctggtccaacaggtttgggtagcatgaagttacttgaatcataccttggaaacagaacaaagctaatgggaagagggggttggtaaaaatagacggaaaagtcacacctttatttttagtgcctaccaagggctcaaagggggccagatacaatgggatttttgctaatttcactgaaattaaagtccatggctcctactacccaccataaaagctagtcatgacaccctttgtagaggg

SEQ ID NO: 14693 - DNA, 1112 bp, Homo sapiens; identical to SEQ ID NO: 14692

SEQ ID NO: 14694 - DNA, 1558 bp, Homo sapiens
tcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattag

SEQ ID NO: 14695 - DNA, 1161 bp, Homo sapiens
ggaggccgaggtgggtggatcacgaggtcaggagatcgagaccatcctggctaacacagtgaaaccccgtctctactaaaattacaaaaaaaattagccgggcgtggtggcgtgcgcctgtagtcccagctactcgggaggctgaggcaggagaatggcgtgaaccagggaggcggaggttgcagtgagccgagatcgcgccactgcaccccagcctggtcgacagagcaagactccgtctcaaaaaaaaaaaggcaaagacgctatccgtttcccttcaagtaaagcagacagaagggatgctgcaggataattgttgcagagtaaatttgtctttcttaacagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaata

SEQ ID NO: 14696 - DNA, 1754 bp, Homo sapiens
ttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatg

SEQ ID NO: 14697 - DNA, 1160 bp, Homo sapiens
gaacccgggaggcggagcttgcagtgagctgagatcgcgccactgcactgcagcctgggtgacagagtgagactccgtctcataaaaaaaaaactaaataaataaataaaaatacaaaaaattagttgggtgtggtggcacgcgcctgtagtcccagctactcaggaggctgaggcaggagaatcgcttgaacccaggtggcagaggttgcagtaagcctagattgtgccactgcactccagcctgggcgacagagcaagactccgtcacaaaaaaagaaaagaaaaagttgatgtaatttaatatgatatatagcttacatctggttcttcctttttggggtttagtatagtcttacagactgagttcttttgtctttttttttttggaagatgtttttgcatgaggatctagattgaattagtacctgaaactgtgttaatgaacttgcttttttatgtacttattttccaggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattca

SEQ ID NO: 14698 - DNA, 1235 bp, Homo sapiens
aaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaaaagaaagaaaaaagaaaatacagtgaactccagatgccactggaacatgggttccagcagcctggccaagctatgtgtcattctttttcctcatgatacccaggatgggctttgtgaggaggcactgtgccgttccagtggctttctgttacagctggccacaccatacaagcaagtacatcatctgcatgcactgctcctcacaggagcttgcacttcattcatatttattctgccctcatttaaggtataagcttagtgtcctaatatatttatttttggaaagggccaagttacaaaacatcttttttttgaggctgcactgttgatatgtcatgcagtggccaccaagaaagtatatactcgtgttagatactgattacatcatttacatcacgctcagtatttggaattaaagatgtgaatgttctgtgaccagagtagggatgacacaaatggaatcagctcctggtggactaagaatcttgaaaaaatctggccacctcatccactacatctggattgagtgtactgcaacaaagaaaaacattaaacaattttatattaaaagaatggctacttttccttggttcttttacctttgcccatggcatccttggccactgcacatcgcctgactcccttggagccacttccgactaaagaagcttttgacgcctgctccagtcttccctcacccgtcagtgggattatttgcatttagaatagtagatagcattgttggcatcagttccacattttctatcagataacagcagctgcagtacctcacagccaatatacagatcaaaactacacttagcatcagaaattcaggtgttatcccagttccttgctggctttggtcctagtggcccatatttaggaaagttttggtttaaaaatatagtaaatgatatttacatgatcctaactggtcatgatagctttcatttgaaaaagaaagtgagatgagattcaattcagcaatgattgagaacttactctgagccaggtgggctgggtttttggaatgggggtcagggaacaggtgaggcccagca

SEQ ID NO: 14699 - DNA, 13088 bp, Homo sapiens
tgagagagtcttgcagtggcgcagtcatggctcattgcagcctccacttctcaggctcaagcagtcctctcacctcagcttctggaagtgttgggattacaggtgtgagccaccacacctggctctaaatatttttcattgagcaccttatcagtgttctaggccattctagtcatttttcttgtttctttagactgttaatttatgttcctcatcttgctcatactcattatcatattatttataaatgaatttggattagaaggggaatgatatgttactatggcgtagatacaatgtagatattgttacatggtgacttttttcttgttatttttcagtgttccattggcaagctacaataatggggccagtaagtattcagattaatttcagaataaacagtttatgtaatttactcattttaatcccacttttcttgttatcaacagaatgacagtccctatcagggtggagtatttttcttgacaattcatttcccaacagattaccccttcaaaccacctaaggtaattaattggaatgtggcagtttttaatgtactttctataatactaataaactagtttacagaaagtttcctttctttctgtaggttgcatttacaacaagaatttatcatccaaatattaacagtaatggcagcatttgtcttgatattctacgatcacagtggtctccagcactaactatttcaaaaggtaacagtgggtatttgatatcaagataaagcaaccgtgtcttttgtctttttagagttatttatttttgaaaagattacttatgtttcttttaagaagagatagcaattcttcttaatctgaaatggaccttgagaactgaaaacgagttggatttttcaagcaaaagtattccttggtgtagtgactagtctgtcagttgtgctactctagcataggttagaagatgaacactgggcctggtgccgtggctcatgcctgtaatctcagcactttgggaggccgaggcgggcagatcacaaggtcagcagatcgagaccatcctggctaacatggtgaaaccccgtctctactaaaaatacaaaaaaattagctgggcatggtggcaggtgcctgtagtcccagctactcgggaggctgaggcaggagaatggtgtgaacccgggaggcagaggtttcagtgagcagagattgtgccactgcactccagcctgggcaacagagcgagactctgtctcaaaaaaaaaaaagaagatggacactggtatgaatgtttttttagagcataaagtagagcacaattaacatctcttccaaccttgagattcatgaatggaaaaagatagatactattgcagaataggaaatagaccagccctttagacaaatgcctatgctgtaaacatagacgttaggttcttgaagaacaaaatataggtaaatattttaccagctcttgtctttaggtttctgtatcaatgaactgagtgatgtagttgttgtcttaatgtgttgatttgaaattgtacaacccttcaacattattcccagatgaaatcacagttgcgttacaataatctagattttttttttttttttttttttttgagatggagtctcactctgtcgcccaggctagactgcagtggtgcaatcttggctcattgaaacctccacctcccgggttcaagcaattctcctgcctcagcctcccttgtagctgggattacaggcacccgccaccacgcctagctaatttttgtatttttagtagagactgggtttcgccatgttggccaggctggtctcgaacgcctgaccttatgatccacctgcctcggcctcccaaagcgctgggattacaggcatgagccaccgtgcccagccaaataatctagaatttataaaggaaaacaaaaacaagtatttatggcctggcacggtggctcacgcctgtaatcccagcactttgggaggccgaggcaggagaatcgcttgaacccaggaggcggaggttgcagtgagctgagattgcgccactgcactccagcctggccagcctgggggacagagcgagactccgtctcaaaaacaagaatatttatcagatctcactgctgtactctgaaaggtgataaaagagttcactggatgtacttttgtgaaaatgaaatcagttgtttaagagaaaaatcaaatatggtaatggattaatatgtttaaaatatgaagtacaaaaatcagaaaaaaattcagatcccaatagatgaatggacacaggggaaccaaagaataaataaatgaatgttacgttcctattttttacctttttaattaacaaagatatttttaaaagaagacaaaacactaatgaggtacattgaaatgaacactcatattcttcaagtagaggtatagatttgtagagcccagtctgccagtatgtgttaagagacttaatcatccatgcccattcacccaataattctagtttcatttatttatactaagaaaacaatcccaaatgctgaaaaaactttgtatacaagtacatttgtgacattgtgatttagttctgaaaattggaggttacttacagtagaggaaaaaatagatcggttccagcacatgcatttaaaagagtattgaccctggccaggcatagtggttcatgcctgtaatcccagaactttatgaggctgagatgggcagatgacttgagaccaggagttcgagaccagcttggccaacatggcaaaaccccatctttactaaaaatacaaaaaattagccaggtgtgatggtgcgtgcctgtagtcccaactactcaggaggctgaggcgggagaatcacttgaacccgggagacggaggttgcagtgagtcaagatggtaccattgcactctagcctgggtgacagagggagactttgtctccaaaaaaaaaaaagtattgatctttacaaatattgtgaaaataggaaaatactgtgcttgagaaaagcagaaaaaagaaaaaaggcatatacactgtaacaagagttacatataaaagtatgttgagtgtccagaaatagacaagcaatgttagttttggtatttgtgtggtgaaatgtggtgtgtgatttttttttttttttttttttttgagagggagtttcgctcttgttgcccaggctggagtgcaatggtgtgatcttgactgactgcaacctccgcctcccgggttcaagcaattctcctgcctcagcctcccaagtagctgggattacaggcacccaccaccacgcctggctaatttttgtatttttagtagaaattatctgcttataatttaccatttgaaccattaagtagaaattatctgcttataatttaccatttgtttaatgcatgtatttagacaggaagcaacatagtttcatggtaaagaacatagattctagatccaattgcctgtgttcagatctcagatccacctcttattaaatgaggctagagacacattggcccctgtattcctcagttttttcatctgtagaaaaggaacaataatacatatttcattgttgttacgaagattaaagaagcaaaaacagacagttaactggttccttgtaagtactccaaaaactggggataaaggcacagttgtcaaaagtgttgggtatttgtcatgttatcacttggatgtcaagactcaatcttaaaaaaaaattattattattattatttgtttttttttgagaaggagtttcacttttgttgcccaggctggagtgcagtggcgcaatctcggctcaccacaacctccacctcccgggttcaagccattctcctgcctcagccttctgagcagctgggattatagggcatgtaccaccacgcccagataattttgtatttttagtagagacggagtttctccatgttggtcaggctggtctcgaactcccaacctcaggtgatccgcccgcctcagcctcccaaagtgctgggattacaggtgtgagccactgctcctggccacaaattaattttttaaagcaaacaaaactctgagacattaatttaaaatttttggagtcccaggcagaaataaaaacaggatgccagagaaccacatttttttaaagttattacaactttaatgaaatagttttttagagaagtgtccccttttcttttggtaggcccccttacaattcaagagctacttgagaaagtgtttgtggacctgtgcctggcctggtgagggtcccattggttgcacttccttcaccaaatagcaatagagatgtaaatctagtaatgggaccaagataagtagaattgtgtgagaggtgtgtgtttggtggggtgaggtgttggagacacaagatagctgaaattattgccatacctctttttgttcttccccttgcctagcgttgattttttttcagctattccaaatgataaggactgttacaagtctgatttgttaggttctctctatctggatagctatcctttaaaatagttgcagtgccattttgttgaatttgattgtattaactgtctcagatttaaggttttaatgagtccctttttgtaaattgaatgtatgggcaagtagttctatgaaatgccttaatcctgtatatgatattattcctttaacatatagtctgtcttcaaggacagaaattttgacccagtattcactctactttgaaggtccgtgatggggacctaaatatttaaaaaacaaaaacaaaaacactgaaaaaaactgaagggaagcagataagtgtgccataaagccatttgattatatgtttttagaagtgaaagtaactgttgctgtaacactagtgaaaaagtaatactggccaggcgcagtggctcatgactgtaatccactttgagaggccaaggaaggtggatcacttgaggtcaggagtttaagaacagcctggccaacatagtgaaacctgatttctaccaataatacaaaaattagcagggcagggtggtgtgtgtctatagtcccaactactcgggaggctgaggcacaagaatcacttgaacctgggagggagaggttgcagtgagccaacatcacaccactgtgctccagcctgggcaacagagcaagagtctgtctcaaaaaaaaaaaaaaagtaatactgatgaagaatatatataggtaaaagttcagtgaagagactatacaggttatagaaataagagttactatctttacagaagaaggtatagtatatgtatcagtccattcttgcactgctataaagaaatacctgagactggataatttataaagaaaagggttttgccaggtgcggtggctcactcttgtaatcccagcactttgggaggccgagatgcgcagatcactgaggtcgggagtttgagaccagcctgaccaacatggagaaaccccatctctaccaaaaatacaaaaattagcctggcttggtggtgcatgcctgtaatcccagctacttgggaggctgaggcgggagaatcgcttgaacccgggaggcggaggttgcaggaagctgggatcgcgccattgcactccagcctgggcaacaagagtgaaactccgtctcaaaaaaaaaggaggtttaattggctcacagttctgtgggctatacagaaagcatggcagcatctgcttctgcggagtcctcgggagcttttactcatggcagaaggcaaagggggagccacctgtctcacatggcagtagcaggaccaagagagagatgggggaggtgccacacactgttaaacagccagatctcatgagaactctatcacaagaacagcaccaaaggggtcgtgctaaaccattcatgaaggatacacccccataatccagtcgcctcccaccaggccccacctccaacgttggggattacagttgaacatgagatttgtgtggggacacagatccaaaccatatcagtatattagaaaccaaaatgaattcttcatgaaatcaagaagctaagtagtgtactaaaaatcttttcacaaggtccagatagccagtactctcctttcctggaaagaaagaaaagccctttctttaaaacctgtcctttaaagttgacttattagaatatttagaagaataagttaaaggaacattcaaaaatttctaacttccctgttgtcatttccaggaaatacatgaagtctttcctaattgatgttagaatgttctatgcttgaagagggcttcaggtgatgacacctgacaataggaaaatgtttttggaatgccagctgccagaattgtgggtaacaggaatgaagagtcagaaaacatctctcctgattttttaaaaaaacttttcatatactcttaaggcaaggaaatagcatttttgttaccaaactgaatagggcatgccaactatttctttacttctcagaagcccttgatctctataggatagatttggtaggaatatgagcgaatcctttccctgctgaatttatgtgttgggagtaaaatgggctgagagttattatctcttggtacagaacacctattagagaaaagaaagatggctgagctctattagcattagtatagaaggatttaaatttattttgtcagaggctactgaacttaatgtaatcagtgactttatgccccctttgcattcagtaaggaatgcataagttaatgatagatatggccgggtgtggtagttcacgcctgtaatcccagcacttcgggaggccgaggcaggtggatcacttgagcctaggagatcaagactagcctggccaacatggcaaaacccaacctctacaaaaaatacaaagaaaattagctacacatggtggcactcacctgtagtcttacctggagagtgaggtgggaggatgacttgagcccaggaggtttaggctgcaatgagccaagatcatgccactgcactccagcctgggcgacagagtgagaccctgtctctaaataaatacatacataaataaataaatattttaaaacataagttaatgacagatttgaacaaaggaaattacactattgagatttgtctgctacatcccaggttgtcaccgaggaaatggcttagatgagattctaaattgtcactgaagagaatttgagacattcatagaagtatgttgtattctctgtaatgagtgtatgaccatccccatttaggggcaagtgtttgcatttatgttcttgatttagactgaattgttttcaactgaaaattaaacaaaacaattgtctgaatgtggtgcctgccactggaaaacagtgattgttggattttatggttgtcgtttttgctaagaatattcagtagtgtggctgtcttttttttttttctttttgaggcagggtctcactctgtcacccagattggagtgcagtggtgtgaacacagctcaatacagccttaacctcttgggcgtaagtgatcctcccacctcagcctcctgagtagctgggaccataggagtgtgccaccacatccagctaatatttttattttttgtagagacagaatctcactctgttgcctaggctggtctcagactcttggcctgaagcgatccttctgctgtggcctcccaaagtgctgtgattacaggagtgagccatcgcacttggaattttgaaagccatttatccttgaatatgggcttctaaaaaattgaactttatgggatctgaaaaatgttcttggtctagaatttagacaaagttctaattctattctaattactagccagggacattgaacacgtcactgcacctgtctgggccagctcccttaggagttcaggcataaagacagtcatatcaactcttcttacatcatgggattgttgtgagactttgcacaaaggggcttatatttgtatctgggagaccaagatgtcatttaacattaattttctgctatttgttttattttattttttattttttattataattattattttttggagatggattttttgctgtgtcgcccaggctggagtgcaatgctacgatctcggctcactgcaacctccacctcccaggttcaagcgattctccagcctcagcctcctgagtagctgggactacaggcacacaccaccacgcccagctaatttttgtatttttagtagagatggggttttaccatgttggccaggatggtctcaatctcttgatctcgtgatccacccccctccgcctcccaaagtgctgggattacaggcatgagccactgcagccagccttcatttttattttttaatgacctaacctaaagtctgtttaagcttcttaaaatccttgttggtaggctgggtgcagtggctcacgcctgtaatcccagcactttgggaggccaaggtgggcggatcacgaggtcaggagatcgagaccatcctggctaacacggtgaaacccccgtctctactaaaaatacaaaaaattagccgggcgtggtggcgggtgcctgtagtcccagctactcaggaggctgaagcaggagaatggtgtgaacctgagaggcggagcttgcagtgagcctagaccgcgccgcgccactgcactccagtctgggcgacagagccagactccgtctcaaaaaataaaaaataaaaaaaactatttgccaggtgtggtggctcacgcttgtaatcccagcactttgggaggccgaggcgggtgaatcacgaggtcaggagttccagaccagcctgaccaacatggcgaaaccccatctctactaaaaatacaaaaattaggccaggcatggtggttcaagcctgtaatcccaggactttgggaggccgaggtgggtggatcacctgaggtcaggagttcgagaccagcctggccaacatggtgaaaccccaattctgctaaaaaaaaaagaaataataataataataataatccttgttggttactgttaatataaagttaagtaaaacttacaaagctgctaggcattacagtataaattcttagaattttctcatgttttggcgtctcatgtttctctcaaccctttgctttgatcctctgctaatttatatgatttttttcattctagtactcttgtccatctgttctctgttgtgtgatcccaatccagatgatcctttagtgcctgagattgctcggatctacaaaacagatagagaaaagtaagtatggcctcaagatggaaagttatctgtggtgggatggagatgtttgtcacaaatctttcttgtttaagggctgaatatcggccagatatttaaagtgaagtcctaatatactctcctggggctagaaaagagaaatatatgcattgagtattattataagtagatgatgccagtcttatccctgattgtttcacgtgactcctcttgtctacaaaaacttttttttttgtttgtttttttttgagacagggtcttactctgtcacccaggctagagtgcaatggtgcagtcttggctcactgcaacctccgcctcctgggttcaagtgattctcatgcctcagcctcccgagtagatgggattacaggcgcaggccaccacgccaggttcgttttttttgtagttttagtagagacttttaccatgttggccaggctggtttcgaactcctgacctcaaatgatctgcctgcctaggcctcccaaagtgctgggattacaggtgtgagccaccacacccatacaaaaactttcctatggtatatttttcaacagcttaatgccttatgcttggcttttgatatataaagcacttttcatcaagtgcccatttgcctgccataggtatttgtcaattaatgggaaaagagaattgatttcctaccatttgacataatctaaaggaagaaagcaaataaatgccattagacgtgaaagccccaaatttcttttaaaaacaaaacttgatgtagaatttgggtattttagaattgtactatgaattattgaacagtggtcaagatatcaaaagagatagtagctaaaagtgttctagtagcattttttcttttctttttttcttttgagatggagtcttgctgtgttgcctgggttggtctcaaactccctacctcagcctctggagtagctaggattataagcatgcccaccatgcccagcactaataacatctgttttatgtagtattcagtgaagttataagaggaactagataggagagggtggatagttcttttagggccgggcgcagtggctcacgcctgtaaccccagcactttgggaggctgaggtgggcagatcacaaggtcaggagtttgagaccagcctggccaacggggtgaaaccccgtctctactaaaaatacaaaaattagccgggcatggtggcgggcacctgtaatcgcagctactcgagaggctgagataattgcttaaactcaggacgtttaggttgcggtgagctgaaattgcaccactgcacttcagcctgggcgacagagcaagactcacgtctccaacttgagttctagtggattagagaggcatagatacgtttttgtttttagtggaggtaacactgggaatgggatattctaacagtagttggttcttgctttttcctatttgtgaatttattgtcaaatttttttgattagagaactgttttgtccgatatttagaattgtgggtctgaatgcttaccagaagtcatttcccaagtcatcatggagtaatgttgaacactgttgaacagaactttcccaaactgcactgcccccaccctctaaccccccacttttttttttgcagagacagggtcttgttcttcagcccagactggagtacagtggcacaatcgtggctcactgcagtgtcaaactcatgggctcaagtgatcctcccaccccagcctccccagtagctgggactgctagtacatgccactacacctttccagcctccccagtagctgggactgctagtacatgccactacacctggctaatttgtttttttttttttttttttgtagagacaggatctcactatgttgcacaggctggtctctaattcctggcctcaagcaggccttctgcctcagccccccaaagtgctgctgttacaggcatgagttaccgtgcaaggccagcatacccacccccacccccccccctttttttttttttttttttttgaggcagggtcttgctctgttgcccggactggaatgcagtggcacaatcacagctcactgtaacctcaacctcccaggctcaagtagtcctcccatctgagcttcccaagtagctgggaccacaggcagatgccatcacatccagctaatttttttttttttgagacagagtcttgctccgttgcccaggtggaatgcagtggcacaatcttggctcactgcagcctctgcctcccaggctcaagtgattcctgtgcctcagcctcctgagtagctgggattacaggcgcacatcaccatgcctggctaatttttgtgttttcagtagagacgggattttgccatgttggccaggctggtctggaactcctgacctcaagtgatccagctgctccagcctcccaaagtgctgggattacaggcgtgagccaccacacccggcctagcacccgttttttaataggagaattatagaatcatttgctctgcttactttattcaaatgttcttctgaagcaataaacccattcattttgtcaaccaaattgttgaaattagttctaccagaaccaattgttttattgatatgaaaggaaagtttggttttttttccccctttttttttgagacagagcctcactctgtcacccaggctatggtacagtattgcaatctcagctcactgcaacctctgcctcctgagctcaaacgatcttcccacctcagcctcctgagtagctgggactatagtcatgcgccaccacaccctgctaatttttgtatttttttgtagagacagggttttatcatgttgcccaggctggtgtgaaacgcctgggctcaagtgatccacccgactcagcctcccaaagtgctgggattacaggtgtgagccaacatgcccagccttctgtcggtttaatcattattagtatatgagttcaagaactatgtaatgtagaatcatataatttcaagtactttaaatgaatgaattgagtggacatcttttgtagaaataggccaatcaagtatggaataaggtatatgccaacaaatactaaaatttaatcagaaccctctataagtagcaattaaaggagactttcacattttacagctccttcccattatcattgaattaatccttatcagaaatttgggatagaaaggggcctttccttgaatgtcctataagctactctcttcaagttacttgatgggataatgaatggaatctgttgcttactgactccacacctatgttaagccaagcttctctttgtgtgtacaggtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattt

SEQ ID NO: 14700 - DNA, 1155 bp, Homo sapiens
tctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggttttaaacttgttcaccttgtcttatctctcactgtcactgctcctccaccttggaacttgtgtgataaaacccaaaacctcttacagttctcttataagcatttcaagcatctcttattagcatccttgactttgcagaaaaggcttaactgttaacagttgtggggaaaggagttagaatttagcttaa

SEQ ID NO: 14701 - DNA, 1230 bp, Homo sapiens
ttgtttatttgtaggatcgacggaaagcgagtgaccccggtttttaaatggggggccaccttcgggacctgtcagaagagctgaaacgcccaaagtgggagcaagatctctttttgttcttttttcccccccgggaatctgaaggggtgcgcggagttgggctggtgcctcgggctgcaaggaagcaccagtaaatttggggggttctgtagtgactcattcggaaagacccgctccctgaagtctcccgcgacgggggtctgaaggtttggcaaccgcgccctcctttgccccctggactttgggtggtctgagagtcgcgccttcggatggggggggagctaagggggtgaccagcggaccagactcctgacccccacctttcctcgcgcggcgggcgctgtttggagcccttggatttgtggtgggccctgtcccccccacccccgcattttctttggaagcgttggggagggggcgtgtgtgagatcgctcggccctcgcccccgccggagccgccccagggccgccggcaaacagagtccctttcaagttttccgctggggccgcctggcgggggctgcgagcgcggtcgctgcggacttgtttggagcgcgatttgaacgcccggctccacctcagctgccccaggccgcggggtggggggcgtctgtcctttgcagttgggagtatttaaattagacgtcttgggggacctactggcctaagcttcacctgatccccctcctgaaagatgcccgtgccttggtttccaaccgccactagaaaaccgggaactgagaccgaagccccctctaaacccctttctgagagccgtgcggggaaactcaggccggcgggctacctacccgtaactgcgtattgttgatttagcagtttccctagatgagagtcaggctggagcttgggggggtggggagtggcccgctctgcagctgtcacccccctcccagaacggaaattgtcctctccttggggaggagggagagggggtgatggtttgatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaaggtgagcctctgcagaagacagacccttgg

SEQ ID NO: 14702 - DNA, 2054 bp, Homo sapiens
agggaggtgtgtgggctcttgtgtctgtctggcagtccaaacccacccccatcccctgaccccacttttcctacctgggcaagtgtctgggggatgccccctcccagtccttggggcctgggggtctggcttcaagacaccagtttactgccccaaaagtcagagccacattctgagaatcctatcaggccataatttgcaaggcaagcataaaactccaggcaaggacctagcattctcagccaggccctgggattctgattcctctcctgggttctgggtcaggtattgagatttccatacaggtcctaagtttctgatgctcagacatggcctaaagcatccagtccatgacctagaactctgggtctctcccctgccctgtttaagggattctgtttcacgggccctgtgcccttaagcccttcatttgcccctccagggccatctttcccccaaggccacccaaggatagagctgttccagtgctgggtgccctgctctgaggcctggaaggacccttggtctgggcacctagttgacagatttttggggctggggtaaggggaggtgaccatgagcccggagtggacaagaacctagccactgtaggattggcttggagaaggcaaggggttcccatgctgctatctctgcacccctgtggcagggcccgtccctgtgcccccagatgcagcaacctagctggagtgccaggcctgggtacaaaagcatcttttcagcctgcagtccctgcccttgtccccgcccctctatgagtgggcttgacgcaaatgtccagaatggttggaaaacaacagtggtatatcccagccatggcctcctggttaccctcccccaaccccagccccagccccagccccagccccagcccttccatttctgctctcctatgtacacacaaaggcacccactttagtccagtgtagacacacatgcacacacacatagacacggccgcttgagaaatagctcaaatacccacctcccacagctccataccacacagctcagcatagcacgaggcacacacccatatgcacacccgtcgcacgtgctcacacgctcatttacagaaacatgccacagccacctggcgctgttgcctttgggccaggggaagggacttcttctctggaaggagggttcctgggcacagtggctcaggaggcctcagagtcctcggggccttccagcagcccagcaggtcaagcgcctcctttggcctggctggggtggcaggagctccgaggggtggctgctcttcctccatgcctgtccctccgccatgaggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcacc

SEQ ID NO: 14703 - DNA, 1312 bp, Homo sapiens
tatttaccagtcaggatcgaacaggtagtgattaagcagatgatctgtcatgtctgaatccctgtctctggatgagagaaaacagcaaggctgcatccagggcaacttttctagcattgttattggttgatttgattttaggggaaaaatagtgaaaataaaaatttttttaaaagaaagaaaggagtctcagaccattacaggatccggttgttacaggctgaatccaaggcccataagtgaagagtttcttttaaaggactctgggacttccaaagacagcctgtcagactgcttactgttggttggtttctttttcacagtctgtttgtatgggttttacttctgaccctctcttacctgaggcttcacctctcccacttcatcccacctggcttccttcctttctgcttaggcctgctgatagaattgctcttctctgaatgtaacatccgttcttcagcccccattgtcaagaatcaggaaaatttccagaaatttttggtataaaattcccaactcttccttagacctcaggtctgacaggcctaatggggaggtaggcataatcctgggataggatgagggtgggaccaaatccagtaaatctggctgagtttcccttaggttggattcttttggacataacatggagtttttttttccagaagtcatcttccataattctaggtctcattttcaaaaggaatcctttctccaaaaaggctagtaacattcactggtctcttagtaacatatacattaagttgtcttggccaagtactgacagagattcctttcagatggcacctccagagctcagcccaggtgattcaggccaatgctaagaaaatcccaccatgtagagccaagtagtattaccatctgggcagagccagacaccaccacctctgagagaaaggagaaaggtctttctgctggaaagaatctaatttgtaagttgaagggaggcacatgggtggctcccagattggaagtgagctttccgtatttgtttcttactgtgtaaattatctgagtaggtttccactgtgtatggtttacactcagtcaactgaaagggcaagcgggagctggagctgagactggttcccttggaagtgctgttttcacctctgccaggcttgcccctgcttcacctatgcccacagacaatgtgggctttgcgcttctcctgtgtggtgttacagcctcagggcctctggtgaatggtctgccttacatccagagcttgtcgtacagaggtaaaaaagttaaaggcattggttttgattagttctgtaaagggatc

SEQ ID NO: 14704 - DNA, 6231 bp, Homo sapiens
ggttcatccgcagagctggccagcaactcaggctgggctcagccctgagcagggtgccccccttccccaaatctcagaaggaggagggggaggcgggcgggcaggcagtcagtcgtggtcccaagggggactggctgcaggtttttgggtgagtgtggagtttctttttgattgttgcatgtggggaagggcagagtcgacgggaacagtcactgcgggcaccctagccctggtgcgtctactgtcctctgctcggctccccccatcggtgagtgcgcccgcccgcccgactgtgcggggctgcggttggggggaggggggagcgggatcatctgaggccagagccactgccgtgtgtgcggggagggggagcggcgggagagagaggggagggacaggctaggtgtctgctgctccacgccactgctgccggcgccccgacctcatccccagcagccccctctgcagctaagggttaccaccgcaccacctctcttctttgcctgcctcagcggccaaggctctgcggtaggagacaacccagccgggtggcgggtgggcctgtctaggtttgggtttgggtcttgctgaggcccgcatgagagggggtggccgtgactcggtgtcccctctttgcagggggctctgctgcgccgcgcaggcccctcctcctacatcctctttggggggtcactggaaagcagagcttaggcccactctctgtgcttagtatggcagactccttctcacccctagtcccctaactccccaggccgaggccgcctagggtctgcccaacagcgacagccacggtggtggtggtggtggtggtggtggtagcagtggtggcggcagcagcggcagcagcagctgcgacgctgcgcgtcctgctccctctcccccacccagccagggttgtagggtgagggccggtgggtgggcgccgcctggcgggcgggcggacggggggctggcagcggggagggggcgcaggtcacgtgccggcgggcgggtgggcgcgtacagtagggcgccctgctactgtactggggagtcagtgccctgttaccgggtctcgtctgtctcgtctctcccgcagatctcgcgagagtggctgactggctgtgggggttgcggcggcagcaggcggagccggggagggaaagcagcggcggctgaggcgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaaaaaaaagggtcttgtctgacagagagttctggggatggaattgtttcttggcaaatccagccatatagatctaactgctgtatgtataagacaccacctgtaggagcgggaaggtatcagtgcttcttatattgtaaagcattggcctaggaaggcaaacagttgtctttttgaaggatttttttctgctggtcctttgggttttgatttgatatttttatgctccctggttgagtgtgttgtcttcgtttttgagatctactgtatgtgttgaataacaagctattttcattgtactgtgcattttcccattaaattgtttgcttttaatattcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgtttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggccttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattcta

SEQ ID NO: 14705 - DNA, 1173 bp, Homo sapiens
tttgtttcactgaagtcagtgagataggagtctagctgggtacatgcttaaaaagctggaagtgaagtgggtggcaagtggcagctccctctttcatgtagttttccataatgttcatatagtttccttatggtctaagtgttacaactggttttcaagttgttatattgaatattcctttttggaattcagggttgaatcactttgagggggaagggaagcaagggcaagagactttattttaaccagatgcggtcttatgacctcaaagatgtgctctagaaagaaaataacaaaaagtgtacctgtgaacatattttttgtcttggtgatattatgcaacacagtgttcagaattgcaaaaaaatttaaaaattgatagttttatcaatggaacagagagatgtgtttttggctaaaattattttttgtaagttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttgcaaattctgttgaacattcagtgatgtatttgaaatgagaaagtcctttataacatagtgtgaatgtttgtggccaattcaattgtggaatcttatggctttgtttttactttgggtagaagtttaacttccattgttcagattttaggtttatctagtgaaattgtgccaggtagttgtctaaatatggaccaattttgggaaatgaagattaataagtgtatatttgattctagataatcctttactcaaaatcataagttaaagattcacatcattaagagttatctaacttttatgttgtcaaatctttaaatgtggatgatattcagcattctatctatgaatttcctttaggaaaagagaaaaattcagtctccaaaccttttcttggagacaaaatttaccacatatcgaaaatgaaaaaaatttagaaagcgatttgattattttttaatggagtttaaccagcttaattaatgatttttccagtttgaagcacttattttcccaatgtgaataaagggaaaagatc

SEQ ID NO: 14706 - DNA, 1131 bp, Homo sapiens
ttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatac

SEQ ID NO: 14707 - DNA, 1165 bp, Homo sapiens
ccttctgactcacccactcagtgcgatgcgagacagccccacagccctcacagcagcccatattcctgctggacagggcagagcgtgcaccatccattttatagctgcagtggctacagacgcctggcccaggccatggaaaaccttgagaggagatagtctgttacggacaggagctttgtcctggaatttcctggcctttgtctgtctgggataacttcatgtactgagacgcctgttttttagagtcttcttccttctgggggaagagtgctactgcctgtcctccacagagcacttttgcttctaccaaagccatcttctccctgctgcctgcccgtgatcacccatggttcggaggtgaggggagcactgtgggcaggtgtgtgtacctggcttgcagtatactcctgaaagttgcctgtcacaaaggaaaagccataaccattggacatcaaagctgtgtcttccagcccggcccattcactctggtcctaacctttgtctgtctctcatattgcagcagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcac

SEQ ID NO: 14708 - DNA, 1222 bp, Homo sapiens
ctttgggaggccgaggcgggtggattacctgacgtcaggagtttgagaccagcctgccaacatggtgaaaccctgtctctcctaaaaatacaaaattagtggggcatggtggtgggcacctgtaatcccagctactcaggaggccgaggcaggaggatcacttaaagctgggaagcggaggtggtagtgagccaagatcgtgccattgcactccagcctgggcaacagaatgacactctgtctcaaagaaaaagaaaagaaaattaaggtgatgcttctaaccaatgataacgaaaaaaagttgagataatagttgtagtgatttgtgtaagggaattgaagaggtatacctagagcattagcataatcataattgtatctgttctgtcatgattgtatatttctttttaaatcttttatttatttttattttttaaatatatattctgctcatgtattatatttcttcttcttctttttaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggtacttaatacatgtatgaatatttataatgtttttcgtaaccactttgattatttgagtattgagtatttgagtttactttatattgcttatgttttccctgtgctataaaattatctagtttataagaaattatatagaaagtctattttagtctatattgcctgtaatatagttttctagtatatgtttattattttaattcagatttattgggttaactgtgaagttaacccaactacttagcttagatttagagggtttccattatttaataacttttgttttatatgatttttccaatgtttatttaaaaaatagtacatgccaaagtaataatacacacaatactgaaaacctgaaaaacacagagtaacacaaagaaaagaaattttttgtttttgagacagaatgtcgctctgtcacccaggctggagtgcagtggcgcgaactcagcccactgcaacctctgcctcctgggctcaagtgattctcgtacctcagcc

SEQ ID NO: 14709 - DNA, 1222 bp, Homo sapiens; identical to SEQ ID NO: 14708

SEQ ID NO: 14710 - DNA, 1241 bp, Homo sapiens
ttcgtgatggttcccaggaggggacatctgggggatccacggctcctcccgcctcgccgaatgctctccccacaccactccacactgttgaggcagttgacaggagccgcagaagaaacaagggacatcctcactcctgagccgctccagagtcgcttctccccggaactaaaaaggtcaaggagagtgaagaccacgcccggctgcagatcacccccacggccactcaccttgtcatccgccatcttccccgccgaacttgttgcgcaggcgcatccccgcctccctcgtgccgactgccccggccatctttacggagggcgaaggcacttccggagcatttttggaaagggggaggtgctttcctagtggccaagtacgcctctctcagatacttccacgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatggtgtgcacggaggggcccggtgggaagaccaggagctgagggaggacgagggaatccgaaaggctactctggggctcaaagacggtgggggatacctctctgtgtagggaccagggggcgaatgaacccggtctttacatgtgatgtcttcaagattgaggagcctggatcttcagcctaagaactgacccattttggggatggagaggggattatgacagcatgttattctgaactcacaaatcatatgctccctcctctctaatccggtgttcctgtagatgacttgtggggggaccacagtctggaggtggaggctggcctgcctcctggctggaggaagatccac

SEQ ID NO: 14711 - DNA, 1512 bp, Homo sapiens
tgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccatgattgtcttgtgtcttctgtctgcgcaactcccctcaaacaattttgttcctctggggtcctgagtatcttaattctgggataacttttagactaagaaaaaattgttttctccaagctgttgccagtggcattatttcctgtgagagttccatggaactgagacatttccctgtcatagagcttttgaaatttccctggagcacaaaacttgggcccaggggaatgcggagagagtcttgggaacagcaggtgctgggccgagcaggacaaactagactctaggccaaaaaactcttaagaaagccgatgtggtttcggttttcatttcctctggttcccttacaatttctgcctgtcatctgtcttaaaatcatggc

SEQ ID NO: 14712 - DNA, 1245 bp, Homo sapiens
aacatggtaaaaccccgtctctactaaacatacaaaaattagccgggtgtggtggcgggcacctgtaatcccagctactcaggaggctgaggcaggagaattgcttgaacccaggaggtggaggttgcagtgagtggagatcgtgccaccacactccagcctgggtgacagagcgagactccgtctcaaaaaaaaaaaaaaaaaaagagagagaatgggctcccagctgaggctggacccatgcaatacattgctcaccgtagttaataataaatgcctacagtgcccccgaaagcttccctgaaacaacccattgcggccatccagaatcagccaaaattctatttggacttgggcttcctagatgtgtttgagacctattgtattaattctaggcataccaaatgtattttgatcatatctctttaatactcttcctgtcttaacaagactaagataaagacaaagatcttttattttactttggtagcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaagctaccagctgctgaagcaaacatgaagggtggcgggggggcagggattctagggccccagagtaagtagaccacactgagtcccttttggtcctcctgcctggatagtgctgagtggaaggggaggagctgggacccaaaggtcttggcttaggtgtgggagcagagaacatgagacctcattatggtcctaaatctccaaaggctctactggacaaacaagcttgatgttaagagagaggggaatgagtgacattgagaaacaagatcacccttgaagagctgtctgctggagagcatacacacgatcctggagctgggcctcttcctgatgcctttccagggcttgcagccctgactgctgcaggaagacctgaacagcctaggggcagggaa

SEQ ID NO: 14713 - DNA, 2039 bp, Homo sapiens
tagtagtacttctgtgtgaatgctttggtggacccttaaggtactacatggaccagcctgggcaacatgatgagaccctgtctctacagattaaaaaaaaaaatttttttttttttttaaattagctgagtatggtggtgtgtgcctgtagtcaggaggctgaggtgggaggatcacttgagcttgggaggtcgaagctgcagtgatcacaccacggcacttcagcctggatgacagagaccctgtctcaaaaaaaaaaaaaaggtactacatggagataagcttgaagttactgtaaaaaagctacctttactcttgccctaagttatttattctgatacgtcctatgtacaagtcagtcagttcagtcctcatatctactaaaagctacctttatgcccaaggtgctagatgagaagacagggcccctgccctggtagagctgagttgggcctggtctcaaaatcccgactagagcctgctttgtttgctccttgaaggtgttagcccagctctcttttatctgccccttccccaggctttggaggagaagatacggaccacggagacacaggtgcttgtggcatctgcacagaagaagctgctagaggaaagactaaagcttgtctcagaactgtgggatgctgggatcaaggtatgggaggcaagccccagggtggcagcaaacttaggtgtgctggacacaaactgaataaaagctcacccataatggatcctgccattacttctcaaaagtagagctaagaacagggtgccagcttggacaccctctgtccctgaggacagcagaagccagccttcatcttctgctcttgtcccctgcaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtgagggaggtgggcaggaaggctaagggacagagaatgtatgccattttggcaggcccatgcccattcaagacctgagaaaaagcctggcattgatattagtacaactcataaaagccttgagggcttaacctgttactgtggtcttagtagggtgagatctccatccctgcatataccttatggtttgttggctcccccaagaggcacactctagcctgaggtgtttaattaggttcctgctcccagctgagacaagcctgatgcctagagggctagaggaaactaggcactcggggagcagtggaatggaagatgcttataccaccttcttctcccatcctggccaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaagcccgggcggcgcacgtgcagtggatacctccacccccctgggaggcggggtcgcgctcagagccaatg

SEQ ID NO: 14714 - DNA, 1208 bp, Homo sapiens
atttgactcaggtgctgtttcttcctgttagatattactgcaatgtctgtgactgtgtggtgaaggactccatcaactttctggatcacattaatggaaagaaacgtaaggcttggaggtagcttgtgactagggctggaattgggttttggaggtggggtggaatggaagggtagctttttttttcttctttttactcatcaaaagatggctggagtaagaagggtagtttctactgggctcttttttgatgcccctattagaactctccagttgtttcagcacaggccgtcttttacttcattatgtaatatttctggaggccgtgaggtaagaggcctcattctggaggccatgaggctttcaacagcacccaaaccatgtgctgctcctggacccagctggccaagggagtttcttttagccataattatttttgctgtgtgttttatgagatgtcagagaagtcaggaaaataatttttgaggggctgaggatgttgtaatgaacttgccttcttcactgttgaccctatgcagatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggtaagggtctcctatccttcccctctcccccagatttgagttttatgttatgaatcatgggagaccctgtcctcatcccactcctactcccacccccagagttgtatctcctgagttctgtatattagcggaaacatttgttgcctttgtttaggattctcatgatctgaaggaaatggctctgaaactacttttttctcctagactctctgggccttatttttttttttgtaatttaaaaaaaaattttttttttttttggtcatacagatatttctcaacttctgatggggttacctactgataaacctatcatcaagttaaaaatatcataagtcaaaaatacataatacacctaacctactgtagtttagcctagcctaccttaatgtgctcagaacacattagcctacaattgacccaaattatctaacacaaagcctattctataataaagtattcatctcattaatttattgaatactgtactgaatgtgaaaaacaatggttgtatggatacttg

SEQ ID NO: 14715 - DNA, 1229 bp, Homo sapiens
agctactcgcgaggctaagaggggcgtattggttgagcctagatggagccagtgcactgcggcctgggtgacagagggagattctgtttctaaaaaaattaaaaagagtaacaggaagtttcactgggcgggggttggaatgtttatctagtttagcagcgaagttctaagataaggtctgaaatacaatttacaccttgtaaagactccactcccctggcccaagcactagttgtaaaagtcgatttgatcacgaagtgaccctgtgtggttgttttgggagcgcagagtctggaagcgaaggaggtgggggcgtttcgagagttgtggaccaggtgactgctgagaaggagacagtaaaccggggacacacctgcggaagagctcttcagggattaggaaaggctacgtccttgtcactgctgtgtgtccccagatggacaactcctcaattgtctggaggtcgggggcgtgttggacagtcctggtcgctgagtcatgctgaagcactctctttttgactcactctttgtgacgtaggtctttctcaccagtcaataaaatataatccgaaagcaacctccgggctggctttagctcagcggttacttcgacagttctttaattgaaacaagcaacctgtctgggttgttcgagacccgcgggcgctctccagtccttttacctctctgggcggttcgagacccgcgggagctctccagtccttttcactgctgaagttcagctccctttccatggtaaaaggaatcagggctcctcggagaaatggctgattttagtactgggcaggaaatatagaaatggacgtggagcatctcatagagctagaaagtaaggaaatgcttaaaaaccaagaacaaccaaactcaacttttaaagttttttcaatgtttagtatgttcatgtgtttgttctaacagttgcctgtatacttgtatcttctcgcccttttttactgaggcccacaggatttttttctttcaaatctaatggatgttctaagatataccttagacttgatcattccatataagttttcctaggtttcctttcgatatgtagacccaatttttttttattatagttttgaagattacatcggttccattattttattcttcttcagggactgcaatgtatgttggatctttgcctctataccactttctctctgatcctttgaattgctttcttgattttatttttat

SEQ ID NO: 14716 - DNA, 1176 bp, Homo sapiens
aatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcactttatagtgtatcttgttctttcatggttggtgggagtcaggtcctcttgtgaggtggttttatggtggagtttagtgactaagcaatttgatcccgttctgcaggtagaggcagtagggtttatgaaaaaaaggaacacagcaggggtaaagaaattgggaatggtcatgtttgcatcatattaagattccaattctatttgatctacttgaaagctgggaaacattagatacagagctttcttaaagtaccctaatttttgtagatgaaggcctttgtgccttttttaaaaa

SEQ ID NO: 14717 - DNA, 2813 bp, Homo sapiens
ccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactttgtgtcattgcgcgtctagatgtttccgaattgcgtgtgtgtgtgtgactgtgcaatatggttgtgtatgcttgcaatgccgttgtgcctatgagacagtgtgcgattgtgtgcctatggatctgtgtaccgtgtgccattgtgtgatcggtccgctgtgggggtggggatctgagtgcggcgtgtcagtgtgcagtggagtgtgcagtctaagcttgcggctgtctccaggcagaagaggagaccccggcgcgggcgggggcgggttggcgccgggcaaacgccttgggtagaggggagaggacgtttcgttagttcccgccccttcctgactaaaattgcctacccgaagcgccccggagggcttcacgggaggagggt

SEQ ID NO: 14718 - DNA, 2813 bp, Homo sapiens; identical to SEQ ID NO: 14717

SEQ ID NO: 14719 - DNA, 2813 bp, Homo sapiens; identical to SEQ ID NO: 14717

SEQ ID NO: 14720 - DNA, 2813 bp, Homo sapiens; identical to SEQ ID NO: 14717

SEQ ID NO: 14721 - DNA, 2813 bp, Homo sapiens; identical to SEQ ID NO: 14717

SEQ ID NO: 14722 - DNA, 2813 bp, Homo sapiens; identical to SEQ ID NO: 14717

SEQ ID NO: 14723 - DNA, 2813 bp, Homo sapiens; identical to SEQ ID NO: 14717

SEQ ID NO: 14724 - DNA, 2813 bp, Homo sapiens; identical to SEQ ID NO: 14717

SEQ ID NO: 14725 - DNA, 2813 bp, Homo sapiens; identical to SEQ ID NO: 14717

SEQ ID NO: 14726 - DNA, 2813 bp, Homo sapiens; identical to SEQ ID NO: 14717

SEQ ID NO: 14727 - DNA, 2813 bp, Homo sapiens; identical to SEQ ID NO: 14717

SEQ ID NO: 14728 - DNA, 2813 bp, Homo sapiens; identical to SEQ ID NO: 14717

SEQ ID NO: 14729 - DNA, 2813 bp, Homo sapiens; identical to SEQ ID NO: 14717

SEQ ID NO: 14730 - DNA, 2813 bp, Homo sapiens; identical to SEQ ID NO: 14717

SEQ ID NO: 14731 - DNA, 2813 bp, Homo sapiens; identical to SEQ ID NO: 14717

SEQ ID NO: 14732 - DNA, 2813 bp, Homo sapiens; identical to SEQ ID NO: 14717

SEQ ID NO: 14733 - DNA, 2813 bp, Homo sapiens; identical to SEQ ID NO: 14717

SEQ ID NO: 14734 - DNA, 2813 bp, Homo sapiens; identical to SEQ ID NO: 14717

SEQ ID NO: 14735 - DNA, 2813 bp, Homo sapiens; identical to SEQ ID NO: 14717

SEQ ID NO: 14736 - DNA, 2813 bp, Homo sapiens; identical to SEQ ID NO: 14717

SEQ ID NO: 14737 - DNA, 2813 bp, Homo sapiens; identical to SEQ ID NO: 14717

SEQ ID NO: 14738 - DNA, 2813 bp, Homo sapiens; identical to SEQ ID NO: 14717

SEQ ID NO: 14739 - DNA, 2296 bp, Homo sapiens
ggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgccttacagcttcctgtgtgaatttctgagctgttttcttttcactctagtccaggctcctctagtctttcctgcctcaaatccctggttgacctgacaaatcactgtgaaaaagctaaaggtgccagacactttacttgggcacagggctagagatgattaatacatggtggctgctgccccaccagagctcacctcagggccgtttggccacagtaaaggagtgggcgcctggttcagctccctgactcttccacattgctgctacttggtttggagcccttttttggaactcacttggaacctttcatgttcccagatgtcacgcaaggtttcctggcagtacctgtgtctcttgctgagggaagcatct

SEQ ID NO: 14740 - DNA, 1181 bp, Homo sapiens
aacaaacaaacaacagtttaaactgccaccttctttttttataggtgtaccatagttcatggtttactattcccctatttaggggtacctacatggctttggtttttgctgttataaacagtgctgtattgaacatccctttgcatgccagtactcatctttgagtaattccttgggctagagaagtgggtctgcttcttggtcttggtcttggtcctttactccttggctgcacagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttggtgagcaagggatacttgctgactgaatcttttgtgggcatttctcactttcccctgggttcctgttggctggtagtaggtatacaatgcccatgtgttccttcctcctcttccctgccccagcaagcagtcaaggagaaccagaagcggcgggagacagaagaaaagatgaggcgagcaaaactagccaaggagaaggcagagaaggagcggctagagaagcagcagaagagagagcaactcatagacatgaatgcaggtgaggagtgaagacgggttgatgggctgagataggaatgttgggaagacttctctgcctagagtctagaggcagagtctcatgtctgagctcacctcctggcaaatgatttttggcagtcttcactccgagatcctgatgccggactttaaccccaattctgatacatgcgcattccaacttgccctggttaaactattaccttttctctcctttgctcgctcttgcattctctctcattcccctgtgattgtggtattgctgtgatatatactgttttccttctgtccatccaaaggttcctctggcctgttctcattccctccactaaatctttcgggtttttttctgtaaaatattttcctgacgctcctcccatcttttaattgtggcgtgtcttccctttctgcttatttcacaaagtactatgtccctagtaccttagcacagttgtatgcacaattagattttaaatggattgaacttttggagcgggtggggagccggtcaccctcttctttc

SEQ ID NO: 14741 - DNA, 1148 bp, Homo sapiens
atgctgtctcaaaaaacaaacaaaaaagatggagcttgaaagataagttggatttttaaataggcacaaaaggaaggataacatggtggaaggggactgctgaactactactaaccaactgttcttgtgaatcaagttttaatggaacacaaccatgcccattcatttatgtattgtctgtgcctgctttcatgctacagtggcagagttgaataattgagaccatatggcctgcaaagcctaaaatagttactatctggtcctttacaggcagcttgctgatccctgcaagtagataggatgtaggtaggaaagcattactgataaatattgaagaaatgaaaatgagatatttattagagttgggggaggttcagtaataaaagggtggttggttgaagaggaggttagttttgaaggaatacaatagaccattataatagagaggaagtgaggggccatttcacgctggacagtagttgcttggtaaagcacagaggtggcttacttttaatcatgcttttctaatcttttccctgctagccaagaaggatcaagaaggtggagaagaaaagaaatctgtgcaaaagaaaaaagtaaaagagttaaaggtgttggattcaaagacagcccagaatctctgtgagtatctcttggtcccaactattcaaaatgtgaaggaattcttttaagaatttttaattctcttgaatctatggtcccttgatatggaactttaattgttcaattcctgctatataccaaccattgcacagtgaattttcagtatcatgtttaatttcttcaatagcactgcaagatttttaagtatccagttttatgtcaaggaaacaagctaagacttttaggaatttgcttagacataaagctagtaagaaggaggtctgggatttgagccttttttttttttttttttttttttgagacacagtctcaccactctgttgcccatgctggggtgtaataatgcgatcacagctcactgccacctcagcttcctgggctcagttgattcttccaccccagcctcccaagtagctgagactacaggtgtgcaccaccatgctcagctaattttttgtagagatggggttttgccatgttgctcaggctggtctcaaactcct

SEQ ID NO: 14742 - DNA, 1258 bp, Homo sapiens
accaacaagaggaggagtggttctcaacggggcctgagaaatggctttggaaaagggtgctgggagaagattagaacttagagtgagatcctgacctctctccccttgctttgcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatcctacgttaggccctgtgtatgtattctacatttattattgtaaatataagaagttaatagaggattttggttaagagttagacaaacctgggcagatttgagaggagtagaagatgacttcaggtttttgaatctgggtgtttagagtagtgatgctagttggtgaagatacactgagataaaacatgttaagtgcttagcacagtgcctgacagaagaagttgcccattatctgtctatgtgaagaacaatgctaaatactgtagtagccacaaacatgaacctttctctagaagagtttacattccagtcagtagtatgataaatattgtagcagatacagactgatacaagaaagaggactgata

SEQ ID NO: 14743 - DNA, 1142 bp, Homo sapiens
cccgtcaccacaccctgctaatttttattttattttattttttttgagacagagtctcgctctgtcgcccaggctggagtgcagtggcgcgatcttggctcactgaaacctccgcctcctgggttcaagcgattctgctgcctcagcctcccaagtagctgggatttcaggcatgcaccatcacgcctggctaattttttttgtatttttagtagagacggggtttcaccatgttagccaggatggtcttgatctcctgatctcatgatctgcccgcctcagcctcccaaagtgctgggattacagtgtgagccactgtacccagccaatttttatatttttagtagagatggggtttcaccatcttgaccaggctggtcttgaactcctgacctcgtgatccacccacctcagcctcccaaattgttgggattacaggtgtgagccaccgcacccagtccctggtctccctttgcccctacttgatagcctcttatttcatcatctaggtcaggtccccatggcccaggcacgagcgggggtccaaggtcccatggatggaaggatgccttccaatggatgtcttcccgtgtctccccgaacaccctatgggatgccatatcttgggtaaggcttccccagcctggtccttgaccttcagtgtagatgagaatgatccttcatgggtatacagccgaacctggaacaagggctagggaatcactgtgtccatttaacaagtaacccatggtattggagcatattcaaggagatattgccactttccacacccccgccatgtatgttttcctcatttaattcagtaaacatttatgtaacaccttgtctgggccaggcatttttgctagtcactacggacatagcagagaacaagatagatacattcttgccttcatggatcttacaataaataataatacattgcatcttttttttattattcattttttttatttttaaattattatttttttctgagacagagtctttctctgtcgcccaggctgaagtgcagcggcatgatcttggctcactgcaacctccgtctcccgggttcaagcaattctcctgcttcagcctcccaagtagctgggattacaggcacgtgccaccacgcctgg

SEQ ID NO: 14744 - DNA, 1145 bp, Homo sapiens
tgaaagaattaattttaaaacttggatagtatttttaaactattctttttctaaccattattctaggatacgaacagggctaggactcctaatggaagaaaaatagtttatttttagaactagatctctttgtcctacatgaggtatatggcagtactaaaagattaaagaacagaaaaaagtcttccatttcagtggctaaaatgtacagctatttctctaccttacggagtcttgctatttctcttcttctcgtggtacttcttgcttctgactttatgttctactctggctcatgttgccgaatagtttaagaagtgctccagtaagaatgtttgtactgttttgtatgtagcacagtgtatcacagcagtaaaaaatagtgttagaataagggcctaacttgcaagtggaaaagatttctagggaaaccaggagttggcagcagcatcatctttccaaactcaccaacatcttcatgtgttttctcctagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtaactgtttaccctgctgatggttgcctcctaattctcttccataaatggagatatcatctcaggaacttccttgatagggctcatggggcagtccgaggccttggagccagcccacaagtt

SEQ ID NO: 14745 - DNA, 1898 bp, Homo sapiens
aagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctg

SEQ ID NO: 14746 - DNA, 1232 bp, Homo sapiens
atagagaaaagagagaagtgtcagctctaagacaaaatttgagagctcctggatgttatgattgataatcaaggaactcttgccactgcctgaattaactactttttgtttttaattttttgtaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacat

SEQ ID NO: 14747 - DNA, 1180 bp, Homo sapiens
atacttttcttaaaggatttgtgcatttcaaggctttcaaaatacgttgccaaatagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcaggtaggtaacagggcaaggtgatcacggaatccttaaaaacactctgtgctttgacattacagtttaaaaaaaaaaaagcttcagaagcagttggaagaaaggttacaaagcaagtctggattttaaataattgagaagtggatacatttaaaaatcacccccagtctcttacattcatctaagaatgtcttttggttcaattgttatgtatgtactcttaagggaatggctgggttttgtctgctagagttagtggaactccttttatttcaattcagctaatcatcaaaaaattgtgactgttaaaattctgcagcatattttgactacaaggatgagtctgggtttccaaagcccccatcttacaatgtagctacaacactgcccagttatgatgaagcggagaggaccaaggctgaagctactatccctttggttcctgggagagtgagtataatttgccatgttacttgatggctgctctgtgggaattaagttattttcattatccaattttgattcgttacttatgattgtattgattagtgaaagtagagctaattttaaaaatcaggtacatttgcttttgggataataaactcatctcttcttaaaaatgatgaggtaaattactagtcagacctgctcatttttccttcatctctcctattaccactactttttcaagtctcctgggatggctgaagtatcttgaagcagaagcacactaatgtttccttgattctgcacacttaatattttgctgttgggtggatagctgctagggaggtctaggaagagaataaatatatgcaaatttgtagaattaaactcataagagggatcttcacattgatttagatgaactccgttcttccagcagtccagatcatgtcatttgtggggacatagtgagttcagattccatctagcctgatgttgatt

SEQ ID NO: 14748 - DNA, 1860 bp, Homo sapiens
ggatgcgcagtagcactgcttccattgtattcttttgttaagaggtttggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaaga

SEQ ID NO: 14749 - DNA, 1223 bp, Homo sapiens
aaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagattgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcatcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtttctggtgtgtttgtgtgtttacttccctgacctcttcagccagcaaggcctcaagtttgagaataagcagccactgaaaggggaagagaagatagggcttcctgggctgggcaatcccttctcccagctctaggacgaccgtagaaccatcggaggaaagctgctcttcattatgaagcggaatactgcaaggagctgctagagcctccttcctgggaaagctgtcccctaaactggagtgtgctgcagatggacagcaaag

SEQ ID NO: 14750 - DNA, 1137 bp, Homo sapiens
aagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgcccccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccc

SEQ ID NO: 14751 - DNA, 1165 bp, Homo sapiens
gagtgaatattttgctgctcctgtgcttacagaggtgtacttcattccaggcactgcttcacatataattatctcatgtgcttagattcattctgcaaatgagaaaacagagactgggggaagcattacctctgagtcacacagctctagcagcaggaccagagcttttgaatccacctggtttgagccagagatggagtccctgccagtgcagagctcttgacttctgccccatctcacttgcccggaatggaacctcttgcaccaagccctagaatttggacttgtgttttctattttggcattgaatctgaggagggtgcgtttgggtgactggcagttttcctaccactagtttttgggggcaagaattctttggtaggaagaaacattgcagtgatagagttgaagtgttatttaagctgtctaatggaatggatcagccctgtaatctggaggaaagactgatggggatctcggtgttctgttctctctacgtccagctctgctaatgtattctaccactactaactactacttgatcaggtcaggtgacctctaaaaatagagggtggagtcaaccattgtgtcctggatttcagacattccgatatcatgagatgcttgctgcgtggtatactactatattaatgtttgtgtattatttttcttcagtcatgtttattatatctataaacagaagtgttttcccagtacaacttaaacataaatacataattatataaacactgggtttagataatctatgttctcttatagctctaaacttttgtggctttattttatagccatattttattttattttacagttattttataactagtatttctagctctttggatttaacttggttttgagtgttaatcataggcaataaaactgtcctctagggattgccaaagttcaggtagatcattgttactattacttccactttatgaatgagatgctggcaatggagatgcaaattctttatagatctagatcccgtaaaggagaaacatgcagcaggtgcttgattaagtgaaaacattgccagttgttttttagactccgagccctgggtagcaaagaccagctaagattttgtattatcctctgaagttttggagttctttctccatcacgggctttgaaggct

SEQ ID NO: 14752 - DNA, 1207 bp, Homo sapiens
tttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaa

SEQ ID NO: 14753 - DNA, 1199 bp, Homo sapiens
caggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatt

SEQ ID NO: 14754 - DNA, 1279 bp, Homo sapiens
cccaggctggcatgcaatggtgcgatcttggcacactgcaacctctgccttccaggttcaagcgattttcctgtgtcagcctcccaagtagctgggatcacaggcgcccatcaccaggcccagctaatttttttgtgtttttagtagagatggtgttttgccatgttggtcaggctagtctcgaactcctgtcctcaagtgattcacccgcctcagccttccaaagtgctgggattacaggtgtgagccaccgcacccagcgtggcttttatttaataatctgaagaaaatatttttgtttagatataacaaccagcgtatttaaaacgtgagttctcagactgctccagggtttgagtgactgtaattaaatgcttatattgataatttattttgttgtagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagatt

SEQ ID NO: 14755 - DNA, 1225 bp, Homo sapiens
ccacttgatgaagattcatgcctttttaaaagcaggtgttacatagaaggaaaggtagaagatgactgaccctgggaaggcgggcaagacataatgaaaatgtgggctttcagttattggtggtatagcatttttttaaagtaatttttatccttgaggaatgaagattgatttgacatagtatctaatgtatgtttatttaccttcctttagggagatgcacttatttacatggaaccagagaaacaagtgatgtccaggtcgtcagatgaatgtgttgtggctctgtgtgaccagtggttagtctcttatagcaagaaaattcccctagtcaatttgctcacctttgacttaaaaaaaaacatatcaatttgtccactcccaggtacttggattatggagaagagaattggaagaaacagacatctcagtgcttgaagaacctggaaacgtaagatgggagaaagtgatgaaggaggaaaaaggagatgaaaaatgtggaaacagtaaagttgaaatgcaacaaaaaaagtgaaccagtaaagatacactttgtcttttgctcttttctagattctgtgaggagaccaggaggaattttgaagccaccttaggttggctacaagaacatgcttgctcaagaacttatggtctaggtaaacaaacttgaaatttttctgtttggataactttgccagttacacagaaaatatacatttttacctttcccccctgccctcaattctagtgttttctgaattgaaagcagtaagtttcctctggatggtcatgaaaactaggatatagtccactatcatctactgtgtggtagaaatatgccctctctatatagattttgtggtgtgacttttttatggagagactccaagcttcaaccatttgtcttttttttcttttttagagacagagtcttgctctgtcgcctaggctggagtgcagtggtgcgatctcagctcactgcaacctctgcctcccgggttcaagcgattctcctgcctcaacctcccgagtagctgggattgcaggcacccaccaccatgcctggctaattttttttgtacttttagtagagacggggtttcaccatgttggccagtttggtcttgaactcccgacctcaggtgatccacctgccttggcctcccaaagtgctgggattataggcgtgagccaccatgcctggcccattttgtcttttatctac

SEQ ID NO: 14756 - DNA, 1088 bp, Homo sapiens
ctttgaggtttgaggtacacaggtcatgataatcctaattttttttttctggcggagtcttgctgtgtcacccaagctggagtgcaatggcatgatctcggctcactgcagcctccgcctccctggttcaagcgattctcctgcctcagcctcctgagttgctgagattacaggtacccgccaccacgcccagctaatttttgtattttagtagagatgggtttcgccctgttggccaggctgatctcgaactcctgacctcaagcaatccacccgcctcggcctcccaaagtgctgggattacacgcatgagccaccgcgcctggctgataaccctaatttttaatgttcatttaaatttcaagataaccatggaaaaatcagtctttatcagtgagcagctcagttctgtgaacccaattcttttttaaagcaagcgtgctgaaatacagagtggattattctctttgtgtccaataggaaagaaaaggaacagccaaagtggactttttgaagaagattgagaaagaaatccaacagaaatgggatactgagagagtgtttgaggtcaatgcatctaatttagagaaacagaccaggtgagtaatagtttgtgaagttctgcacattgtatttctatatatatatatatatatatatatttttttttttttttttttgagacggagtcttgctctgtcgcccaggctggagtgcagtggcgcaatctcggctcactgcaagctccgcctcccaggttcatgccattctcctgcctcagcctcccgagcagctgggactacaggcacccaccaccatgcccagctaattttttgtatttttagtagagatgatgtttcactgtgttagccagggtggtctcgatcttctgacctcgtgatccacccgcctcggcctcccaaagtcctgggattacaggcgtgagccaccacgcccggccctgtgcattgtatttctaaaaccgttggctttatagtacagaaacagcttggtggaacccataaggtagattgtatttataatgcctgaaacagggtgaaggaggtgactttcactttctgcatatg

SEQ ID NO: 14757 - DNA, 1108 bp, Homo sapiens
gtccccttagagaatattaatgaaatgttccatttggttaggggtgcttagtattaaaatcatccaagtcatttttttatgacaagtagtacaacttgtatattgaatcatcagcctaacatcaaaaattggtctttgtttaggaacacttttttttgagccttttttcttttctatttcaaattttctgttttcccctgcccacccctccccatactttggattcacctctttttttcatttctccccacccagtataattgcaggagggatgttttttctctgtatatatttgattagaggaattatgtggtagatttgcaactttctaaaaaagcatagatatgcatttggatgactcaagagtagtatttatactatagatttgtttgcagacttggtttctatagcctgcatatggcttttatatctgtatattataggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttggtgagtagatgagtgtccccctaaaaactctgtagttatttatctgtctctatcacaggggtgcaagaaattctcttaaagttgtacctttaatatgtctgagcagtgtaaaaactggaattgtctcaagaagctcaatatccattttgttagaaaacagggctctattctggggatggagtcaagggagtttgattaaaaaggagctattcaagtgtatcattgtacatgtctagacttaactcattttgtataatggatacaaatatcctttaatcaataaagctatcacgtgaggaagagggttgcctgcttttcttctttgtttggttttctaaaagtaattgatttgctgtaagggtgcttgaagtttataaaattaaatggataaaataagtagattattgggatcccaaccactcatcttctgagatacaagtttggaagtcagttcttagataaccttcttat

SEQ ID NO: 14758 - DNA, 2431 bp, Homo sapiens
gcctgtttgtcctttggcctaaaaagtattttacttaccattcttgtgccactaagcagattttaacctctctttcttcaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaa

SEQ ID NO: 14759 - DNA, 1914 bp, Homo sapiens
tgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacccacccaccctcagccctgatctggagggaccaccactaggggtgggagggtaattcagcttctgaggccctttcactccttggagtctttgctgaggcgacttacaaaggtgaccactgccgtgaaatttttcttaaaaaaaaaaaaaaaaaaaaaaatggaaacacaattaggaactagatggacatttccagctcatttctgaaagacctgtgaacagcagtcagtaattcttggacttctttttcttatttcagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatatatctgtattgtatatgattattgttacttaatttttaagagcttattttaacctgtttttaaaagcagcaaatagaatttcccacaaagtaagttgactctaaatcttaagtattacctagtttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttaaaaaaaaatctttttattttatgccttcataggttgctcgtttca

SEQ ID NO: 14760 - DNA, 1113 bp, Homo sapiens
gatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaacattgttctccagtcttcttctttgtgtgatgtgcattttcacctataatattaaaattgcccagtagaactgaaagggttagtaagaggggcaggcagatctgctgataacagagttgtctggagaaaaattgggggcttctatttttgaaattgagttgttagttttgaccaccaagcttgatggccattttgaaactttggagaatgagtaagtttttttcttctgtggatcatcaaatttagtattatatgccatttgggataaatctagctaagtccagaacagagccataaagctttttgttttgggttttttttttttttttggtctttcccctaaagccttgctatttgattgttttggaagcattttctgcttctttttaatagcctagacttgaagaaaaactcaaattacacccataccaaagtat

SEQ ID NO: 14761 - DNA, 2179 bp, Homo sapiens
gccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttg

SEQ ID NO: 14762 - DNA, 1191 bp, Homo sapiens
tggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtag

SEQ ID NO: 14763 - DNA, 3051 bp, Homo sapiens
agctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgag

SEQ ID NO: 14764 - DNA, 1128 bp, Homo sapiens
ttgcggccacattgggattaactgaatctcataaaaggaccaccaaggtgaacaacttagggcttttaggccctgtatggcagtatgtcaccctctttctagacacacagaagtagcctttgaataatgtaaaactaaatgtaaacctaaaaaatgccaacatttggttgatgaaacctggagaagcttttcaataagaattcattagaagatgaacagttttattcaaacgaaggcatttaatgctatagtgaaaggaacctgtagccagaaaacttagattcaggctagttttacacttgagatcttaagttaacttcttcctttcatggaccttagtttccttatttattgcccatatgttattaaaaatgagagaatgtttgtgaatgtcatcaactgtaaaatcccttatgtatacaaggtattcttatttttctaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacagggtaagtcagtgtgtttgtataatatagggctttggaaatgccccatgtttcttttatctcatgtctgtacagcatgcctgagagaggcagcagagaccaggcaatggttcctgttttagagatacagaaaccaaggcctagagatatataaagattgtcccttcccccggactctgctattcatgtactgctgtcagattacttacacatctcttcttgtcagtctccctaaagcattaattagagtcttgctggtataggctctgg

SEQ ID NO: 14765 - DNA, 1235 bp, Homo sapiens
atgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcat

SEQ ID NO: 14766 - DNA, 1607 bp, Homo sapiens
agatcaagccattgcactttagcctgggcaacaagagtgaaattccatctcaaaaaaaaaaaaaaaagtacaattattatgtgtcaatcaaaaataaaataaaacttgaagaaacctggagtagctgtattaatatcagacaaaatagacttcagaacaagaaatatttccaggcataatgagggacattacatagtgaagacagaatcaattttacaagaagacataacaatcctgggtgtatatgcactttagaacagagcttcagtttttttttccggctggaaccatggagggtgtagaagagaagaagaaggaggttcctgctgtgccagaaacccttaagaaaaagcgaaggaatttcgcagagctgaagatgaagcgcctgagaaagaagtttgcccaaaagatgcttcgaaaggcaaggaggaagcttatctatgaaaaagcaaagcactatcacaaggaatataggcagatgtacaggactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcgtggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattggaaaaaaaaaaaaaaaaaaaaagaacagagcttcaaactacatgaaacaaaactgatagacccgaaaggagagatataaaaatctcttgtaacacccttctcccagttgtaggtggtacaagtagagagcaaatcagcaaggttatagaaaacctgaataaaatcgtaaatgattgacctaattgatttttatccacctaacaattgcagaatacacattcatctcaagggcatatagaacattcaccaagatataccatattctatcacttaagatacatctttaaaagtttaaataagttatgcaaagtatttcttgcatcacaacagaatcaaacttgaaattattaacaaaaaggtatctgggaaattgaaaatatttggaaattaaacacacttataaacaacccaagagtcaaagaagaagtcacatgaaaaattagaaaatattttgaattggataagaaaacaatggtctaaggctaccaccttaagaaactagaaaaag

SEQ ID NO: 14767 - DNA, 1096 bp, Homo sapiens
ggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgag

SEQ ID NO: 14768 - DNA, 1182 bp, Homo sapiens
tgggccatgtatcaggagggctgcatcagaacctctggggttggggcaactagactgtaaatacctccccaggtgaattgcatattccaaccaggcagccttggaaaactgcttagaccactccctgcattcagcaagtaactgtttctgaagccagccggggaaagaaggcagaattggacattctggccgtggctttgcttccagtagggacagcagccttgggtcgctccctttccctctgggcttgtggttttcccactttgtataagggagctgatcctgctgaatgtagggcttcactgtgagggtcaggtgggctctgggagttgtgaagtgctgtgctgggtcttagcagatgtgtggggtgggagggggcaccctgggcagctggaatggcttctgtgcccagctgcccctgagctcagtggaccctttgccttgtaaaacactccctaaccccatcacctcctttccctggccaagcctttaatcactgggggggtgttttgtttttgtttttcaaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggtgagcgcagcccttatgcagtggtgggaggggctgccagcactgccccacattgaggcccagaagggacaggacactggctgagtcacatagcaaggtgttggtcgggaggggcttggggtcaggtctctgggccctgcattagccattctgattagggcctggctcagacctgcagttctgggggaatagttgccagagcttttttgtggcagccccagtcatggagcccagaccagtggctagaagctgcagggaccaggttcctacatagtctaagaaagaattctgtatcagttgactgcctgtggaacaagtggtcagggtggtagtgagcttcccgtccttggtggcatgtaaagtaggttaggcaatccctaagccagagacatcacagggatagatttcatctatcagagagacaggaccaatctgaggtttctttgacttctgagaatctgtgattct

SEQ ID NO: 14769 - DNA, 1223 bp, Homo sapiens
ggcggatctgtccaaaggatcctcccacctgcatctactgagtagctgggacaacagtgtgtgccacaccgggctttttttttttgtagcggggagtttcaccatgttgcccaggttggtcccaaactcctggcctcaggcgttccaccagcctcagtctcccaaagcccaaagtgctaggattacaggcatgagccaccgcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgcttt

SEQ ID NO: 14770 - DNA, 1132 bp, Homo sapiens
cgtgaacaagccagacagtggtcagaacataacaacaaaccatagtggccccctcagcctaaaatatttactgtctggcttttttttttttcctcttttttgagacagggtctcactctcacccaggctggagtgcagtggcgctatctcagcttactgcagtctctggctttcaggctctagcagtcctcccacctcagcctcccgagtagctgggactgctagtagtagtgccaccacgcctggctaaattgtgtatttttgtagagatggggtttcaccatgttgctcaggctggtcttgaactcctgagctgaagcagtccgccctgccttagcctcccaaggtgctgagattatgggtgtgaaccactgtgtacagccctgtctggctctttacagaaagtttgcagacctctgaactagcggggtgttgggatcttagaaaggagatcttccattgacttggccaaaggctcttcttaacttaaaccttcattttctaggaccaagacccctggacctggggcccagtcggccctcagagcccttgcccgctcgggtatgaagatcgggcggattggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcc

SEQ ID NO: 14771 - DNA, 1204 bp, Homo sapiens
tgctgttttgtccaggtaagaaaatgtgcttgtccatttagcccacaaatattgtgatttcccaggggttacaagagaggagacacattcttcgtccttacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggtacgagtcgcagaggggatggctgggtggtagaaaacctgctgggcttgggtgctggagcacctggatttgaggtttgggttttttgttgtgaccttgaacaagatattttaggcatatacatacttaataattggctcctgtgtacaccccccagcagctcagtgttgagcacccactgtatactaggagctgtgtttcaggtactagaagagagtgatggggaaacagacatggtctctaccctccttgtgtgggaccgaggctggtgggagagtcagactttaaacaacagagcaccagggagtatgtggttttcatttgtgacaaatgccaggaagcacaagtaaggagttggtgataaagtgtaatttaaactagggtctaaatgataagtccggagtccttccagtgaaataaggacaggaggagggtattccagctagagacaactgcagggaaaggtcttgaggtgggggtgaacctgggcacctgtgaaggaaagagtggcatgagg

SEQ ID NO: 14772 - DNA, 1950 bp, Homo sapiens
ggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctc

SEQ ID NO: 14773 - DNA, 1258 bp, Homo sapiens
ttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggtt

SEQ ID NO: 14774 - DNA, 1137 bp, Homo sapiens
aacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcacatgttgtcatgggtttatttctagattcctctttatcctttggtagctgaactcgaggtcagtggaagttatttaatagaaatgagttatatattgtaaattttttaaatgttgctttagacttttgattatatccattccgtgatgatttacttatttttttttaacctcagcctattcttaggttgattccatgatgatttaaaaggctcagacctctttagtatttatctcaaagggtgattgtgaggttgaaataagatagtgcacagaaacacttagcacagagcctggtgtagggtagttgataaagggtaactttaagaagtcacccagctgggtgcatgccgatagtgccagctacttaagaggctgaggtgggaggattgcttgag

SEQ ID NO: 14775 - DNA, 1218 bp, Homo sapiens
ccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgagcctactgtgtgtggtgcttcttcaatggtggccgcccccgcctgggtgggaagtgaggaggagaaggtggggcagggtaaaggggggaggatgagaaaagaacaaatatgacaacaaaaactttttacagtgggtgcaaaggtaattgcggttttcgccatatggcaaaatccaaggctacctccccaccccacaattctccctgagatcagccaaggcagactgcaagggccatgtagccctattaggggtggcatcttcatgaggga

SEQ ID NO: 14776 - DNA, 1223 bp, Homo sapiens
agagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttgg

SEQ ID NO: 14777 - DNA, 1928 bp, Homo sapiens
tttcagaaggccattgatgaattccccctctttagctgtgtatttgtgcacgtgtgtgtgtacgtgcgtgtgtgtgtgtgttcctgtgtaagtaacagaccagactccttttctcttctgtcccgtcaccaggctcttgcttcactgcagatacagttcactctgaaagctggttgaaggagagcagcaaaaatgtatcaggggttttgcttctgtgtttcgccaaagctcataagggctgtgacccacccatatggccccagttttttctgtctcttctgttccaaagccaggagagctgacttccaggtgaagggatgggaaaagtggactctcattgtagtgactcccaacctacctaataatttgttaacttaggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttactttttcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtgg

SEQ ID NO: 14778 - DNA, 1961 bp, Homo sapiens
gccggctgcttcggcatcaagcagagtgagtgtctgaacaaagaagcaaggggcatgggcagaaacactgctcccagggtgctgggttgtcatccccccactctccgctctcttggtctgtctgttgtctgtcctctctgcctgtctctgctctctctgcctatttgactcctgtctcttgggcgtcttcctgatccttctctgtccatccaactgtccctctctctttcccttcctcaagcgttagcactcacccgtgctaaacactattttgggaactggcaggcacacagagaggaaacaggaagtgtaacttggcagcgtgtgtaagagacagggacaggccagagacagagagagcgagattcctccgtcactgacttcctgggtgaccttgcatggccacctagacccctgcccctggggatgggtgggagtccactgactccttgggaagtgcgttatcatcgacacagccttatttttaaccgtgctcttttcttgctttgcagaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatcctttt

SEQ ID NO: 14779 - DNA, 1194 bp, Homo sapiens
tttcctcatctgtcaagaagggataataataggccaggtgcggcgggtaatgcctgtaatcccagcactttgggaggctaaggcaggcagatcacaaagtcaggactttgagaccagcctggccaacatggtgaaaccccgtctctactaaatatacaaaaaaattagccgggcatggtggcggacgcctgtagtcccagctactcgggagtctgaggcaggagaatcgcttgaacccaggaggcggaggttgcagtgagctgagatcgtgccactgcactgcagcctgggtgacactgtgagactcagtctcaaaaaaaaaaaaaaaaaaaaagaatcatcccacttactgactttaaaaacctactttaaacctactggcttttaaaatctacccattttataagtctttataaaagaccccagaggccatgaggaaccagaactacccagttatgcatctggtggtagagccaatcttgagattctcctataaagaagtgattactctgtccatgaaatagattttccatcaccctcaaatttatttttgcccctcagaggtggaggaggagagcactgaactgtaatgtttatacccagaagctggtttctggcttctgacctttatactgtgggggatgggacctactccctgtagtcagcgacagaaagtttcaggtatctgttgactttaggtccttgggcagcaaaaaactgtgctccctaaaaatgtgtttctagtttcagagcttctgctgagagtcagggttatgagggctggcggtgtactttgcttttccagaaccagcaagatttccctggagcgaagaaagcctaggttcatattccatactcagtagttatttgccacatgactgcaagctacctagtgaactcttgggaacttcactttcctcctgagtgaaataagataaatagctctctttccaggctcagtgaggactaacttagatactgtacaaagataatttgacatgtaatagacaatcagtagatttagctcttatgttgatcttgcaaacccttcaaagctttggctcagtatataagtacaaaccatagatgaattgattttctgctggttatcctagagcaagactcagcaaacttttttttttacacggcaccgatagtaaacattttagtcttcacaaaccatagggtctctgg

SEQ ID NO: 14780 - DNA, 1973 bp, Homo sapiens
gggattacaggcatgagtcaccgtgcccagcctctgctggttcattattacagctttctttatctttgatagtgatagccagctcatcagtactcttaagtctggtcaccttgattcttacagcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaag

SEQ ID NO: 14781 - DNA, 1143 bp, Homo sapiens
aaaaaaaattactttgtggtaacttcaaggtcataaattatggatagcctagaaattatccttcatgagtgaatactaaattatacatttcaaaacagaagttcttcctacttggagacttaagggcattaactagatgcagcaatcctcagcttggtgttatcacatactagaggacatttggaaatgtgtgaaatttggaagggttgttggagagacatgcatctggcatttattgggtggggtctaaggataccaaatgttgtgtaaaaatgaagcaaccccattgagaacactgatagtccctattcctgtgggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaat

SEQ ID NO: 14782 - DNA, 1638 bp, Homo sapiens
ttaaataactaatattttctttttcttgttttttcaatcctggcaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattctccaactttgtggttttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataacatagattagtataaagactgtttctacgtaatcttctttggggcaggagtcagttagtaagcaaggaagagaaataaatttggtttaaaaaggtataccaacagcactacaatgttactctgcctatattctgtcttaatatgatcagaaagtt

SEQ ID NO: 14783 - DNA, 1198 bp, Homo sapiens
aggtggaatatggataaggcagcgggcatatttagtaatctttttgctataatttttttttcatttctgttcaattatcaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttgga

SEQ ID NO: 14784 - DNA, 1164 bp, Homo sapiens
ggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgc

SEQ ID NO: 14785 - DNA, 1266 bp, Homo sapiens
gtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctaga

SEQ ID NO: 14786 - DNA, 1174 bp, Homo sapiens
accactaaaccactcgccttagcctcttctgcagtttctggtggctctatctgtgggcaagggactcctgcctgtgagaagtggccaggccctccagagcaacggggtctggcttcagggagcagtggggtgtggggaaagcaatgttcatcttggctgctccatttttataccatccatcaaggactcttgcgcttctctccacctgtgacgtagcagcattgccttctttcctcttggtgcttctgggcaaaactggaatttgaaatccagaactggcgttgtcttcttaaagagtatggttcctgcctcagttccagcctggtatggttctttgatatgccctgaaggttctcacatggaaacatcagtatcctgccattcatgttgttttaagatgttttaaaaaccaatggacaaacttcttgcttcaaggaacaaactcttaggttggcaacagcatataaaaaaaaagatcacagctgaatctcatgaaagattaaaaaccaaaggattcaagaccggtgttgtaaaatgaagaggaattttacttacatgttacagctgccaagtttttagatgttcctgtcatagctaaatagtcactgctagcctttcagagaacagatagtaacaattgtttgcagctgcagtgttgcatctaattttggtgtttaggctttttattttgtgggaagctttttgttaatatcctgcagggcaactgcctgttgggagggagaggatggaagaaggagcttactctgggggccttgcctattgagggaggctgttgcccagagcagttgcttcatggaagtcatccaaaggcgctctcagtcattacaatgacaggatctcaaagttgggaaagggctgttaagtcatccagtctagtctccacataggtgctgacattctgcctacaaccatcccaccaaggggttgagcagtctggacttaaacacctccgaggacagagaacccactacctcgtggagaagcctgttctttgtaaacctctggcttttctatgttctctgtaatttccatcttagtctctgccccatgggggccacatgggacaagttatttttggcaaagcacctaattgctggcactgtcccaaagcatagcgtttgccttttggaaagaaacaatgctaggacatgga

SEQ ID NO: 14787 - DNA, 4037 bp, Homo sapiens
agaggactcctagtcagttctcttcttcccagcacttttgttctggccagtggcttagagtctttactcactggctgtggccgcttttacttcacagacagagttgttgttgataggccagggggcatctcttccttcccacagactacctagacaacatggccctgttgcagggaataattttgcccctgtgagcctcagcaccgctgtcctgaaggttgtctctgtcacttagacttggaagctggagagataagttgccttcccaccttctggcctatttgaccatgcttcccactgaaaccatctcaggtgtgaaaatgaccttagaatacatcccatccagcctgccattgcatgctgtggctcctgcctgcccttctagtgacagggagtgccttccctcctataccatgaggcactcacactcacctcactgttactttacttcctgctatagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggtgagtgactgggagcaggacttgggagaaggtggcagggtagaactgtgaaatgtcaggactccaggggactgctggaggagctttaggtgccacctctgaaaagtcaatggggaaactgatggatgtaggctggtgagatagcagtcttcaaccatctgtcattaatcagtccctcctttcaaaaaacctgctgaaattttggcttctctaatgctgatctagagtaaccatggtttaaacaagataaaactttctttctttgatgtaacagcttggtgtaaatacaccaggcctggtatggcaactcctgaatcccttcagcttgctgtggtacaccggttcttcatatcatcactgatggcttcctatttccttcttcttctagctaggaggaaaggaagagggaagggtggcccctttccttttagggactcaacctggagttggttacttcagcttagctctcgtaggcagtgttttggcacctgtctatagggactctggaaagcatggtcttcatcctgggctgccatgtgtctgactccagaaggggattctgtggccatggagacactgatcttgggagttaacgaggagtctctaacacactgacggccactgaccagcttattttagagatgaaaaagagggctaatgtgtgggaaagggatctgcccaaggtaaccagattgtgatttgggcccaagtccagggcagaagaagaggagttgggtagagctggctaggagtggcctctccctcaagcctttctcatgtacccatgctgtctcccaggaaacaaacacaagtgggttccattacaaatagacatgaagcctgaagtgcccagagagaaactggcttcacgccccactcgcccaccggagcctagacacatacctgccaatcgcggagagatcaaaggtatgcactacccactatggagggcctggacttgggagacaccctcaggcctgacctggtacccctctccccatagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaagtacgtgaggcccctttgggctccgggatgtccaagggtgtgcagcaggggtggtgggcaggaatctcctctccctcatggcacccgtttcccccatagcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagatgtgagtgtgcggaagccttcttaccctggagaaatgagtgagaggttaggggttgctagagtgtcatagctgggcaggcccttctggtgcttagcagcagtttcagcctcaggctgaaaagatagcttttctcattgtttattaaagaagtgataccacattctcattgtttattacagaagtggtacaacatttaccttaagaaagttagaaactataccattacaaaaaggaaggaaaatatttagaatctacccccttctgttcttccatttgtaatgacaacattgacagaatactaacatttattgaatccttagtatcggccaggctcagtgtttattgttgtagaggcattatcttagtcctgcagttcttatctgttgaattcctatgagctgagtcttttagccccagtttatagacaagcaaaccggcccagtaatttgcacagaatctcacagctagtaagtaacaaagcacagatttaaatccttttctgtcctattatagaacctttgttcttaaccactctgatatattgtctctcagtccagtaaggaagtcatacaagaaaataaatggttgcaatagagtgtttataagtgttttaggagcagaagagaaagtgaccaacaatatttggactggaatttaaaggaggatgaggagtttgacaggcatgtcgaggggcttagggcagagggagtgatttgacccaagcaaggtagggtgtcatgaagggatcacatcatttcttttcagccctcaacactgttggtatataggataaggatggggtaggtcagaggctgtgtgagattgctggggtgtgtagcagaacaaggaaggcatactcataaaactgatgcaccaatccctcggtgataactacttcttccctccacttagtgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggtatgtcttcctccctggagctgggatgcaggggaaagaaaggtccttagggagctggagtttgggccaaggcagaaagccctggaagagtcatcatctgatgacttctgctgaagtctcaaggcttggctagtctcctcctctccctccttccttcctttctctccctctcttgctcattatggaaaatgtcagacacttaacaaaagtagagtagtataatgagcccatcatcagcttcggcaggtatcagtttatggctaatcttattccatctgtaccctcatctgtttattctcacatactacattgaagaaaatcctagaaaacctagcattttgttcacaaatatttcagtatagatttctaaaagatagacttgttaaaagaaaatagccacagtatcattatcatacctaaattaacagtttaacatattaacagttccttaatatcatcaaatatttagttcagattcatcccaattggcgccatatatatatttatatatatattttatatatatttatatatattttatatacatttatatataaaatatacatttatatatatttatatattatatatttattatatatttatatttatatattatatatttatatattatatatatttttatacatattatatatttatatattatatatttttatatatattatatatttatatattatatatatttttatatatattatatatttatatattatatatttatatatagtatatatattatatatatattttatatatttatatatagtatatatattatatatattttatatatttatatattatatatatattttatgtatttatatattatatatatattttatatatata

SEQ ID NO: 14788 - DNA, 1123 bp, Homo sapiens
tgagttcctcggtgacatttttcttaagggatcatgcagcatctggcagcgatgtttctggcttcttgattcttggctcttctttttgctccatctaaatttctggggctgcgtttttggtgtcttttccctgagtatgtccccactatcatgtatgtaagccccttaggtcctcagaagaaggaagggagagggagcagatgcatggcccaaatatggagttagtctacacaagtctgctgcactaatggcaaggtgaccttgggaagcctgttcatacctcaaggcttcagtttctccatctgcagatgaaaggaaggagacattagaatattctagaaatagtttatatatataaacagatgaagttcactgttaaagaagtattgcaatctctaactaaaattactacttcctttttaagtgctgaatttttctccacatacctgctcactgtcacccactttggagacctctggcctggggcttgtgaggagactgcagaattgaccttgaactttgggtctatggaattctatactcccttatctattttcccacagtgattacctctcatctcctttctcttgcctgcctgttcatacacagaattccccacagttgtggcttcagccctcaaaaagtgttggagatccagccagagacatgaggagaaaggtagtaagtagatgagggttttacaaagtccaggcctacaaagttttgtttgaaacaggggtcagacttagctcccattccagaattagagcccctactctgacctggtctatcttaaaccttaaaaaaagataggtttagagtttatgtgctcttggcacagcagggaatctacttttgaataaatactgtgggtttagacaaatgcttctctctcagcgtctcatattcagtctatcaaaacaaatagtttttctttgctgaaggcaccgtgttttctcttgcctttggaacaatggtattctttctgcctagtctgtccctatcttcatctggcttacttatgttcatcctgtggtagtcacttcttgaaggaggccttccgtaaccattcttagtcacagttgactaagctcctttaactgtgtgcatccacaaacctgct

SEQ ID NO: 14789 - DNA, 2990 bp, Homo sapiens
agggtcatagttgaacagtcttatgttgagaggctggagcttccctctcatggtatagctacagaatctgggccaaggatctctggtgattccttttccccttcgtctgtcctattttagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaaggtgaggcttggacatagcagtgagtgtggagcctggtgtgcctgtattgtacggagaagaggaagcctgattagctgtgcaattttaggcaggtccttataattcagagtctcaggatttttatatatgggaaggggatgatgactgacatctagcttgggcattaggagtgaggggtgatgtgtaaacactgcaaactcttcaggtgaggcggtggtgattattatcctatctgcggatccatagttaatattctgacagttggctagacacttttgtggggaacagaaaaagggttagattgttatttctagtcttaaatatttaggcatctaaaaatttagaagccttttaagaagcttgtgttgagtatggaaaatggagaaaagataagtcttttgaaaaattgctgctgcctggaaatagtcaaaacatctctgttgtgggattttagagtgggtatgtttggtggtaggttgtcctagggtgagcctttgtaataagtagcagtgtgtttcctggaagtaaggaggaaggagagttgcccagccactgtgtgataaggcagtagcagaaagagagatggggaaacactggagctttcaggggggagtgtgtagtgagttcctgaggagctactgtcagcctgatctcagtcttactacagggagggcagggcaagcactgtcttcttctgggctagcacacttgtgccaaggtaactggggtgaggaatggtgactgggcagctgagagcctggggaccagaattccacgtatgtcgacgtgggagctgccctctccaacttcctgccagtcttgattccttaaacaggctagagcagcctgcttacttacatctttccccactcatctcatgacctctgcagcaagaagtcgagaacttcaaaaaggtcaatatgatcagccgggagcagtttgacacactgacccctgagccccctgtggatcccaaccaggaagttcctcctgggccacctcggttccagcaaggtgagaagcagacacctgagatcctgacatgggtgagaggatctagggcccttggactgggggctatcctggggtggatgccacaggcctttccctgcttcctgactcctctctctgcctctgcagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaaggtgaggcattcctgtcgggctgctcagagtcttgggtctacttcattgcattccagtgctttgcttctctcccttgccttgtctgagctaaggaagtgctaaatccttcacctgctctgtgttctgaggctggtgggcttacctaggattaggtagccacatctgcaaaatatactgggtgtgggagtggtaaccccatgttgaaaggcctaaggaggattgaccaggtatgagtccttgggcaaatcactgcattcccaaaccttgatttcttcacctgtttgaaataggcataccagttcctagctcaccactgtgaactttatacgagaatgaatatgaaaatgctgttgtaaaatgtgagagatcatgcccatcttagtcctacaagtgcttgatgctcctcagagttgtaggagtacaaacagtaacaaaccctgggctaacctttgcagatgcctcgaaaaagaaagacaagacacagttcaaacccacccttggagagccatgtgggctgggtgatggattcccgtgagcacaggccccgtactgcttccatcaggtacctggggcagtgggggaagagtgatcaggctgcctatgggatgggtgggcgagccatgaaattgactggaccaagaagattggtctgaaaattaaagggaccctcatctaagaggttttcaaaaaaccagtggtgtggaaagctcagcccaggacctgggaatgacgggtaggcttttttcctaaagaagtggtgtggcagtcacgtgagaccagattttcatacatgcagagagaaaatctctgaattggtttccaagcctggctatctactttctgtctgaggaagaatagccaggtagttgaataaacagatttctggcagtctctctgagcctactatgtcttgggaggctacttgaaaagttttaaaaattaaaaaaatacatatttattggccccaacctgtatctgctgaccctgcttcttggggtagggcccacactcttttttatttatttcagtaagatggccccagtgtgtgtttcctgtttcccaaagcaagctttgagagccacctacctatgaccaatgctctctactccctgcagagatggcacagactgc

SEQ ID NO: 14790 - DNA, 3842 bp, Homo sapiens
tgtgactccttcctctgttgcagccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggaaaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaatactggctggtcttccatctaggttactgctattgggtgtgaaggatgggtttctggtagagttcccccagatccggaggaaccctgcactcaatgtgca

SEQ ID NO: 14791 - DNA, 2431 bp, Homo sapiens
caggcgtgagccactgtgcctggccgagcctttctatactattagtttttttttctagtttggtatattttcagggctttaggaaggctgggaggtggtgatgtggtagtggtttttttcttttttgagatggagtcttcgctatgttgcccaggctggagtgcagtggtacggccttggcccactgcaccctctgcctcctgggcgcaagtgattcttccgcctcagcctcccaagtagctgggattacaggtatgtgccaccatgcccggctcatttttgtacttttagtagagatggggttttgccatgttggccaggctggtctcgacctcctgaccccaagtgatctgcccgcctcagcctcacaaagtgcttggattccagacgtgagccattgcacccggccagatgtgataatatttatacttgtcatgacttctagcataactctcaccatggttctctgtcccattctgcagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcattaaggtttggtctttcatagctatggattgctggctctggaagatggtcatttgccatcagtgaaataagagcatcttgcctccattgtccccaagttggcttacatacaaaatatcacttggggggtgggttcgggaataaaaaaaatacatatcacttggtaggaagcttttcacgagcacctgtgtaaatggaattgtctcttcatactcaagattgttgggtcttaatattatagaattaaaccagtctaatatttcctggggtcactccactatatatggtggattagcttgttaattagtgggattcttttaaacaacctgaacttcagatatcctagagttggctcaagactttgtttccagccatttctgttgacacaaaatatgtggggttttaagaagtctggtacaggggcagatatggaattgtgactgggaa

SEQ ID NO: 14792 - DNA, 1158 bp, Homo sapiens
aatcgcttgaacctgggaggcagaagttgcggtgagctgagatctcgccattgcactcccgccggggcaagaagagcgaaaccatctccaaaaaaaaaaaaaaaaaaaaaaaaaaggacatctgggtaaaattggcagaacttaaatagagagtatggagtaggtggcagtagtgaatcgtgttaatttcctgatttccatggttgtactatggtgacgtcggagcatgtcctgttcataagacacacactaaaatatttgggtgttattgggcatcatgtttatgatttaatgaaatttcaaaagggtttggttaatattgtgataatataattctaaaagttcattgagaagaaagggaatgggtaaaaatgctattaaagaggaatgagatattggagtttaccacctagagtgcttttaaccaagaatgtatactttagtcagtcctttattgtgattcttgtaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcgggtatgtggcagaatcctgtgtatcactaggatttcatggtcgtgtctgggaaactaagctaggtccttactcagtttgaaacttcgctgttcccatttttccaactcttggaaacagcattagttttttttgttaagctttattcaagtctctaaaataaacatctttgaagttttaaaggggttctagtggatgtttgtggtggaaatagtaaagttctacagagaaaacttcttattcaacttgggcaaggtaaaaccgtgggacgaagcgaagctgggtcagttgtgtacataggaacttacatgggaaaagttttaacagtatgacatcagtagccacatttggtgaaagaaactactgtcccttacaaatgtctgacctagaagctaccaccactgtgggaacttgcaagctctcacccccttacgtggagtttgtacgcggctttctgtcttctc

SEQ ID NO: 14793 - DNA, 1165 bp, Homo sapiens
tctttattacctctccaacactggatctccctttttatcaaagacaagcaagcaggcattaagctcagaatcactggcaggcaatagaagctaagtcagattatttaatattatcttgttttcatgatgtttattcttatgtctcttcccttctgtttgcagcaggagggtgctggtttttcacttatggagtaatataaggctgtctttgaaaataagtttacgcttaaaaaatgagtcaatttaaaggaaagtattattaataatagtgaagataatccatggttttaaaaaatagagagcggtggtatgtgattgcctaaaagttggaaaacactccagagcaagggttctcacaaattatttccaaataatcccaaattatttccaaataatcccctcaagggcagaggaaactggacatctacctttgcccaaaagtgtacctctgagagcctacttgtaactcaagtgtttccttcaagtgctgtgttttatttgtcatgcaaatttttgctttctactttataacatatccatgtttgttttaatgttaaaacaatgctttcaattcttaactgtgtcctccgagtggacgctgctgctgagatgcctcgtttgtgccttggcataccctgggggatacattttccagcttgagaagctttgtcatggggcattcatccaacccaggtgacctacaatagcagtgacgtttgatgggagagaaatgggtagtctatagacacatttgtacaaacgacctactgtgtggaaagctttaggctacatgatgcgggcgctctcctccccactctcattccccacaatgaggcagtatagcgggtgggtcaccaccccccctctgtaaggcacccgcatcaggggcatcctggttggcttcgggatccagttcagctccatctctggagttcttgcgtggcatttccaccagggggagcccctgcaggtcttcctccctctgaccaagatccggggcctcctctggccatctcaccaacccattggcctcctccatgtggccagccctgtaagaccatcgcggctcatggcaacggacacaccagaactggaggcagatgaaggccaagacggctgtgaagcaggccagcagaatggccatcagcacccaaagggagatctg

SEQ ID NO: 14794 - DNA, 3088 bp, Homo sapiens
tgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttatctggtttggcagctctttattgtgtgtttgttgtaatgtcctactgctcagattagataggattcatgacgtggacttcagaaagagttcccacaaggatggtcagttcagcctataaagccttcatggtggaccctgagccacagcaaagcctatgttttcctatgaccagtagagggggctgtttgtctttacacctggacgcaggctgcttattaaaggcctgaatgatcctgagattcttcgatatgttttttctcatcctacactactgcatatagaagacagctgagagcctctgctcacctcctcatcttattaaggcaagggatcatactttaaagaggggagacacttgccccaggtctcttgggctgggtaggcaggcacagccagggataaggttgggtgtgctttctgattccagaaccctgcg

SEQ ID NO: 14795 - DNA, 1103 bp, Homo sapiens
atatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatctt

SEQ ID NO: 14796 - DNA, 1153 bp, Homo sapiens
aaaatgcagattttggccccggataggctctgaaggctctttctgcactacctcttttttttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcactacctctttaaaggatgctctgtgagtagaaaaatgcaaaagaagtctctgcctcaggaaatttgctctacctgtggagacatcctgggaaatagtgggcagtgggataaaggaaaaaggtgccccaaatcacgggaccttgaagttggggacgaacttctaggtcagaacccgcaggttcaggcaacagaaaatacaagaagggaaactacagagcagaaattatagactgctgtttgcacaacccacagatttgagcattaatccatattttttctctatgttcttttccccatgtcctgagactacctcaccaacccaggaacccatatttgacaaaaacttgtttgctgaaatcaaatggaatcctccttagttagctgcaggcatccagggagatgaacagggttatgtgagccccagcgccatatcctgtcctttcttggctttttcccaaaaggagggcacactgaattgctcaaccagattcctggatgctcactgggccgcattactagtgagcaggatcactctattacaagatcaccttcaaaagcaaatgaatggctcaactagtaggcactttgcccagaggctctttggccatatgcttctgtcttctagtatcttaaacacattctaggactctcatttcttcaatacactgtccttcctcaagtccaaatgatgatggcttgagaaagggagagacgtcctttggtctaaccccatccatttgtgctccagcccagttagctaaagagagatcttatttgctcaagttt

SEQ ID NO: 14797 - DNA, 1145 bp, Homo sapiens
acatatgtattatgtgcattatagttagaaataggaaatttatggccaggcgtggtggctcatgcctgtaatcccagcactttgggaggccgaggcgggtgaatcatgaggtcaggagatcgagaccatcctggctaacacggtgaaaccccatctctactaaaaatacaaaaattagttgggcagggtggcaggcgcctgtagtcctagctacttgggaggctgaggcaggagaattgcttgaacctgggaggtggaggtcgcagtgagctgagatcgcaccactgcactctagcctgggcgacagagtgagactccgtctccaaaaaaaaaaaaaaaaaaaaagatttattactaacttttaaaaaattgcaaagcaaggagtccacagaacataattaaagaatttggtctttttctgtatgttgaaagagggtgatgaaggctaaagagaaggctaatatttatcattgtttgctttatagctatttgatcggctgaaacttcaagattcctccaagaaggaagcagattctaagtctgcagttgaagattccactctgtctagatactcacagacatccacttggaagttggcttcagtgtggggaagagcagacactggccggggctcacacaagcgttcccgctctgtcccttcttccctgcaggcctctgcaagggaggagtccaggtcagagctgtcagggaggactacacggacagacggctccagtgtgggaggtaccttttccagggctaccaccctttccagaggccagtcccgtaagaaaaagcgaaagcccaaagtggattaccagcaggtattcactcgacacataaatcagattttcattcgaggcgagaatgtcctgctggttcatcttgcacagtgaccagctcagcctgagctttggtttttagaaataaagtgcatgaattgctgctatgctgtatcctagtatcccagtgaaactctgagttggaatgattccctctggtcctgcatatgcagaggacggagcaggctcagccccctggaagatgagctcaaggggaggacaggccttgggagggcaggcgtttgcattaatatcaaggcaaaaagcattcatagatacatgcatctgatttggtattgtgat

SEQ ID NO: 14798 - DNA, 1121 bp, Homo sapiens
tgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttt

SEQ ID NO: 14799 - DNA, 1211 bp, Homo sapiens
atactgaggcgtgacagttattgagactttttagcttattgggacatgtagcattcagattggagttccttcagttgtattttttaagatactgttgctatccaatgcttttctgaaaattgggaaaccattaagggacaggaataaaatataacatattaagtgtcttttgtgaaaacagaaagattttcatttctcttttgcttatatagcttgtgttggttttgtgttttccactactcctttcagtagcctttaagaatttcctgatatgctgtgctgtgcattaaggttgtgtaagtattcataaacaaaagcttttgaatctgcattcctgccacttaatgactggcattacatgctatgccttgctgtaattgtgttgattcagcactgtgggagctttctgttttcctttgaaaatgattttattatgaggaaaagcctgagaaataaggacttgtagataccttttgaatttaatgtcgttagaattgcttctttttttaatgctctatctaggtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcaggtattttaccactttgtctcccgggtctcttagaaagagccctaaatttatgccactgggtttttggttttttgttggttttgtttggggtattaacattatctgaaattgggcctttttttttttttttaatagacttcatttgtttttagagcaatttaagctcacagaaaaattgtgcataaagtacagagttgtcatatacccacttccccttcataacaggttctgtgaacatcttgcattactatggtgcatttgttaacaattgaaaagccagtatggatacacttattaactaaagtctgtagtttacgttggggtttcctatattgtacacttctatgggtttcgacaaatgcataatattcctcattactgtattgtatagaatagtttcactgccataaatatgccctgtgcagaaatgtggaacaagtcttaaatgtgcaagttatccttgcacagggggcatgctaatcttccctgtattgttctggttttagtacat

SEQ ID NO: 14800 - DNA, 1686 bp, Homo sapiens
ggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataattatgttttgttcttgtggtttgttgtcattataaagtgctttttttgaagttctgttcttaggaggttctgtttttaatttagttggacttacatgttgatccttgtcagaaatgccctgtagatggcaaaactctttgattgaaaaggaccatttcttttgaaatcttctacacccagtgttagcaaacttacctgtgcttcagaagtgtttgggaagctttttattttaaaaaagtacacatttctgaaccttacttctgattcagattgaatcagccttttggggtgcctgagcatt

SEQ ID NO: 14801 - DNA, 1186 bp, Homo sapiens
acgtctgacggtgtggctttttgttttctatgcctggattactaagatcacccacattttagtcatcagtgtcttctctttagagttgattttttatttattaaaacttttttttcccctggatactcttctgtatatttgaaatattgcaccctaaaaacatcaggaatgtgttattgtttaaagcctatgaaaaaagtatcttagtgatcatatttcaagatacgtacatttttttttttttttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggtaactccttcaataagaatgtgtttgggtaagtcatacagtgtatcccttgggactgtaaccatattaaccaaattcaacttaaatttctaggcaaaattatcttctggattaaaaaaaatggacctcagaaattatattaaagacctgataaaatatttccattttatttctaaattaagttttaaatttagtcccttgggttctaatgtattgttgttttcaacattattgctcacccataaataaaggaaaaacaggtcaggtgcattttatatttactcctgaatacacactcacacggactattgaatatactatccatgaggggtcagcaactcctgaaaagtggtgtgccaaaattctgactcttttccctctagtatttccagagtggggaagaaatattcatgtacctaacataggtagagagaatatgtgcccacctgtgggttgctaagtatccgagggtacaagcatttggtgggagtgggtgaatatggtaaaggctaccaaactgatgtaaaattgaagttggcctacctatagtctttagcacatgcaccataaagagcctgat

SEQ ID NO: 14802 - DNA, 1184 bp, Homo sapiens
taacttatgatttagttatttggggcagtttacttggccctccaaaaataaagattaaaaaattatcagaacaaatattgttgcagtatgatcttgaacaagtaattatatctcttggattttatgctttcacctatagaccagaacagttaaatattgcgtacctttggaaaagaagttatgtataaacattagcaactgaattgtcacaatactgaattagacattgtttaaagttttcttcatattacacatggcatcacagacgaccagtggagatttatgctgctctttccagatcagccctacagaattagtattcaaaattcacagaacatgtgaatatgtaattatagtcagatgaagtttaagtttgatttaaaatattatctacgagattttagttagacttcttcaaaagttgtgttattatccttatcaacagtgttttttgtttgtttttattttgtggatgccaaatactcaaaattaaatgtattctattccctattttaggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtaagactgctgacaaccacaaacaggtagataaaattctacataaatgttaagtacattaaagttatagttcatttttatttcacagttatggtaccattcatttttgcagtttcaaaacagctgctattttcagcccaattaggagcatctgaaagattcttgattatgttctattgagaaggcagtaaagtgaagtggttctcttaaagcagatttatctgagatcgaaccctgatgctgctgttcactagctgtgtaaccttgtgataattgcgttactttctgtaaaacggagctaataatgaaagctgtgctttcctcatagagttctgtgagatttaaatgagtttagtaccaggcagacaatgttccatatgtgttagctattgtaatgaagacaaaaataataaagaattgaatacctataag

SEQ ID NO: 14803 - DNA, 1236 bp, Homo sapiens
cagtgtcaaacttctcatgcatggagcatgaattcttactaatagagactgtagtttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaaccttta

SEQ ID NO: 14804 - DNA, 1866 bp, Homo sapiens
atttactgaaaatgttgtatatggttcagtgaatgtaatgtatgtgatgcttaacataaagctatctgagaaaacattctgattcaagactggaaatatctactttaagtatagtcaactattctgtcattgcttagggcagctgtttgtttttaccaaaaatgtagaacctaaagaaatgaaggtctttgaacttttgggggaagagatagtagatttttgtagtcttgttttttaatatgaaatagttttcgggaaaggttatataaataagcatcagatgttgtttacgtttaagaaattgaattatagatgttaacttaatgtcttctttttttcttccatttctttcaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtct

SEQ ID NO: 14805 - DNA, 1062 bp, Homo sapiens
tatgcctattgatatgatctgtttttatatttggcatttactttaaatttatctcttttagccttctgtgttggcattgtctatcattgcattagagatccaagcacagaagtgtgtagagttaacagaaggaatagaatgtcttcagaaacattccaaggtatgtgaaggacatagcctaaatcctattaacagctgtaaaagaaactaaaccccttctatctcctgaagtaaaatgagatgtcatatgtttatttgaaacttaagtagctatcctcaaatgtttttaatgagcaaagacacatgttcataggattgcatttattaatgtagttaaataaggtgggacttacttggagtaataattttttaaaatttatgtatgtacagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggtaaatttggtccgttattattctccagatagagaacattttccaatgccataattttcaactaaagaagagtaattatcttcaaaataaacaaaatggagttggaatagtaaagggggagatgacatcactgatctagtcagctaatatttgaaggcctttactatatacaaggtacaacatcttaggagtaaggaattatccaacctctgatacatacgttagccatttcattaaattttcagcttagagaacagcatcctccttgtagcactaaaatcatgcttttttttaattgcacatgatcttgctgtatgtatctgactgatttaaaattacataagctgagcaggacaacagcaccaaaagtctgaaccaagtatgaactaatttgagactgttagcttataagcaaaatcaatatgaacttggatattgtacttaaaagaaaaaaaagtaggccggatgcagtggctc

SEQ ID NO: 14806 - DNA, 1781 bp, Homo sapiens
tagccagtcgcggtggcgggcgcctgtagtcccagctactcgggaggctgaggcaggagaatggcgggaacccgggaggcggagtttgcagtgagctgagatcgcgccactacactccagcctgggcgacagagcaagactccgccacaaaaaaaaaaaaaaaaagaaaaaaagtaggatatgatagatggtctctacattgggtatctggaaactgccagagtgtgtcaacactatactaacctatcattgctatagcagctggactactgcaaagtagttatatgcataaaaaatgtaaacttgctttctgcatatgtgatatacattcttgccatataaatttcctaactcagtgatgatttattctactcaaaactaaatgttaacatttaatacatctacatgtgattatgaatattagatatgaacatttcaattttcttagtagtatttaggcagactggcttctgttaagttggattttgtttgttttctttatttaaataggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcaga

SEQ ID NO: 14807 - DNA, 1357 bp, Homo sapiens
gcctgtaatcccaacactttgggaggctgacgcaggaggatcccttgagcccaggaatttgagactagcctgggcaatggagggagatctcatctctgtttaaaaatatatacatatttaaaaaaaggtcagggggaacaaagccctcaaaatatagcctttcacttacttttgatttttttgtgtttatctttctttaaagattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgatccagaatgttaacttac

SEQ ID NO: 14808 - DNA, 1126 bp, Homo sapiens
tctcagagattgacattgggtttggaaattgatcctggtttattcttttttttttttttttttttttcagacagagtctcattatgtcatccaggctggagtgcagtggcacgatctcagcttgctgcaacctccccctcctgggttcaagcaattcccctgccttagcctcccaagtagctgggattacaggtgcctgccaccatactggctaatttttgtatttttagtagagacggagttttaccatgttggccaggctggtctcaagctccttgacctcaagtgatccacctgcctcagcctcccaatgtgctgggattacaggcgtgagccaccacacccaaccccctggcttattatttgtttgactactccaaatggagaatcactgtcatttagtaaatgagtttgccccacttacatttattgtgatttgtctatgcattttgctttttgttttctgctagtggataccacaggccaccagcccaacagatatttgtgagatgctgacctagaatctctggggtctgttccagaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagctgtgagtacctcccactaccaccacccccaccgacaccaacagagaatggccacactgagttctgccaatattgcttctcaagtctgcccatttctcttcacctctactctttgtccaaaccaccatcttgtttactgctcttcctgctcctacctgtgccttgcagtgattcatttgccatttgcgtttcattttatttcatttgtaatcatctcagaatgccagtcggattacatatctcctcatttaaaagctttcagggactaggggaattgggaatggggaattcttagttaacgagtacagagtttcagtttgggaagaagaaaatttctagaggtggatggtagtatgttcacaacagtgtaaatgtacttaat

SEQ ID NO: 14809 - DNA, 1146 bp, Homo sapiens
ttgcaggttacagattatatcataaaaccttcaaccaaaataacatgaggaaagagcttttgttattccattcagagagatgagcaacttgcccaaggccacacagccagtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggtggggctggggccccagggtgtgtaggacccttctctcactggcagtctgtcctcagcccccagatgggggaagaatgagggggctccgggcccctgggctccaccctgagcacgctcagttcagagatctctcaggttgccgacataggaaatcaggaaagatggtttgccatccagtgcgccagctaccctggaattttgcatggtgaatcatgctaccaaaaagtctgcttaggtgcaggtgttcaaaaatgtatcttctgactcaattaagccacataactctatataacttaaagcagtcattttccaactttttgacagtgatgcacattttatactgtaacctgatccaaggttcacaaaatagtgcatgctctttctacctctgatggtcctctgatgttttctcccttctgttgcattttgtttcatgcagtttgtgactcaccaaattgatttcaccccatgctaagtaaggggttgcagtttg

SEQ ID NO: 14810 - DNA, 1244 bp, Homo sapiens
agtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaag

SEQ ID NO: 14811 - DNA, 1157 bp, Homo sapiens
actctcccctcatacattagaaaatggccagtatctcattctaaaatgagtagagggccagtcaacactgacctcaagattattctttaaatagcgacagttgttttcatttttttgccttcacctttagttggcttgattaaaaagatcattatatggagcccttctactgagaacatcattaggtaaaatccctccaaataaaagatacatattccccttgcctttctgctttgtcgtaatctcccccctttcttctttcctcctcttcctcctcctcctcttccccctcctccccttccctgtgtgtgcccttctgttcccaatgcattccaattgatgaccattgactccttcattcattcttgtattcattcagtaaacatctgttgtgagcccactattttcctgtcattgttctgtgcttggaaagacagaaacaaacaaaacagacacatttctgcctgtatgacacttgccttctagtgatggaggggataaacaagcaacaaagtaaagtaagttagataacatgtcagaaggtagattctgtggagaaaaataaaataagaaaaggacatgaaataagcgagagaaccaaatggctatctggaggaagagtattataggttgagggaatcgcatgtgcaaaggccctgacgctggagtgggcctgatgctccagaaggccagtgtggctggagtagagtagacaaaagggatggtaacaggggatgagatcagagaggtaaggaggggccgcatcctgggacgttttaaagactttggctttaccttgattgaaacgggaagaagcatacgacttaccacagtggagtggagacttcgcttcttctttcttcacctactttgccagcttttctttaattcctttacagtcccattttccagccatagtagacacaacccatgcctccgcaccctctggcaggcaggagctggttagtaaagagtcctttctgcctgccctctccgccttctgcggccctccaccttcctttccacaaatactgacaattcattcccttagggttttaatgcacctctccttcagtccctgtggtccagtgctctagctttagagagcgctccctctacggaatctacttagtcctcacctacttctcctgctcctc

SEQ ID NO: 14812 - DNA, 1220 bp, Homo sapiens
aagccaaagagaagaaaccctgggtgataaagagcttacttcatggactttgttgcctgagcggtgctgactgctggagagagagcaaggtccatatggcttccttatgggggacgtggaagtcaccagccctgctgcagccaacatggagacatagtcatggctctcaccctgcaggagcagctctctaggctttggggtagcctggggccagattctgttgccctgagcttcagaaacaggcaaaggaaagaaaggtggtgtgtaggaaaggcctgcagatattaccagcttgtctgtggaagccacagacatctcagggtgaaaacagagaccaaaagtacctcttgcaaaatagtcattaggctgtgaacataggaagacgagaagatatagtggaaataatagtcaataacacaaccacgaagcagcaactattatttgttgaacgcttacaaagcaccaggggctctaaatgccataatcttcagaatctcctttaatcttcataattatcctgggaaatgggtattaccatttcattttattatggaggaaatggggctcagagatgataaataatttgctcaagctaaaatttagatggtggcgctgataacccaaattgcctaacccattaacctttctgtgtactaggagtgggaagaggggaaaccgcagatttgaagccacactaccatatcccacctccaccacataggtccataattttgtttttctaagcctcagtattcactgtgtaaatggatatagcaacagccagagttgtggagacagtcaaggataatggtgtattgtaagtatcagtctattctctgactcatattaagggctcatctggcccttcttcattttgttccttcttcccatgactaagacacagacccaagctttccatcattgccgtcattgttcattgtctatggtattcctcagagctctgcaggaagtgggatccacagacccaccttctgcctttgaagtatttgccatctaaaatgaacatacatttatggaacacacagtcaggagccaagaacagcccaaacagttgtgaaaagagcaaagggtattttcatcatatgcatgtcaaagggagttgcattttagaggaagattttttttttaatcattcgtctttgttgagcttcagctccatgggataaagagcggagagagatctggaaatatgcaggtgg

SEQ ID NO: 14813 - DNA, 1136 bp, Homo sapiens
tgtcccgctccactgcatcccaaggaggtaaagtgagaagacgatatttctgactcagagagcaaccctacacctcagttcacttatttttatttcatacagtttgtcacatgagttacctgtctcctgctgcgatctggtgactaaggtgaaataccgctctatggtgtactgagcaagccgcaggtgttccagtccacgcacagagtcgttccctctcagccaggtgaactccacatcatttccatcatagccccctggcaaataaaatggagccctggtcagtgcaagggtgttccagattgaactggtctggtctggaaaatgctataatatggagacagcatgagttctttcttcatagtgataagtccaaggacaatcccatgcagaacttagcaagatttcccaagtgcaattgcaatgtctgctctgaatgaagtgacctgccaggacgatttgccgtcaattgagagctggtcttgtgttaggtactgcgtagatctggtggatgataagtcattagaagtggcctccctcattatttaaattacatttattaagcacatatctgtgaacacgcaaagatactgcctttcaagattgtataatagctctgatgatattttcagggacttaagaactgatctgttcatatttctatattggcataaatgcaaaaacaaaaacaaaaaacctgctttattaaagcctgtaaaaatgcacgttagataagtctcaaagcagtttaattaatatacttgataatagtaacaatagttaccttttgaacatttataagtactttatacattatgtcactaatgttcttgtaaacttgcaaggtagccatttctatatttcctcaattctaagatggacatttctttacattttctgaaattgaactggatcttgtagttgatttatatctatataatatataaatattataatatatataatatatataatatataatataatataatatataatatataaacgtatatatgtattttaatatacagtaaagcttatattttttcctgaaatgttattattcaataaatgctgttccatagaactcagtcactataatgattttcccacattattcttgaaaactctcagat

SEQ ID NO: 14814 - DNA, 1143 bp, Homo sapiens
agaaagaatataaatttggttatctgcaacttgtgcatgatcatttcccccatccatctccctaacctcatctggtatctccttgctgtgtttatcagccgcactgacctttaatgctttgagatgactaaattccactctactgaaggaccctggtaaatgttctttctttgcctggactgccttctagtctttttaaaatctgattcactgttgtaggtctcagcataaatattatttcttgaggcctacctttccaaatccttgttgtagacaagttctccctttcttgtacttttccattgcagaactatcaatttgtaagtaaataatttggggagtaggagatgggcctgttttgtttgcaactgtatcccctagtaagtagttgtatatcgataaacatgtattgaattaatgaatacacatgtgatatttgtatcccttgttttttgtggttaaatatttacctcatttttttcattgaagtaaaatgttaatttttttttctttgaagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacagtaagtatttggtaacaatgattaaccatgaaagatcagtagatgtatgtcattgttaatgaactcgtgtgttagcaatggtaactgatagatattgccacatggtttttttgtttttgtgaaactatagtttcactgtcaaaggggttaatcaggaaaagaattggaaaacctggaaagcaaacttagggaagagccaggaaatgaaataggaatgaattgagatagtttcttgattactattggtctctttttatgtctcatattagtgggcaaatttacatttttaggaagttgactaacaacttaaaaaaatctagataggggaggcagattgtaattacctcagaaacatgaaaggatgattcgaaagcatgctgattacctcttgcctgcctcccatctagatattcatagtctagacattcatattcatttagtaaaatatttaaatgtcaaatcagatgctgtactgctta

SEQ ID NO: 14815 - DNA, 1184 bp, Homo sapiens
ggtaagggttggtgggggtatttgaaaaatatctattaatttgattactttgctggaaatgttcattacagggttttaggtaaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccatgtttttcacaggatgtcaactctgaaaaatattcatggaatgattagagggaagtagagtaatattttaatgttactctgggtggtaaaataatagagatgttggtttctttatacttttttgcatttataaatttgctatattatgtgttcattagttttatagtaagaataaaagttaatttaaaaatgtatgtttagtaattttattctgtaattcttattgtaggaagatgtaatattttaaataacttctgctttatttctttgtagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgaggtattcaaaaactaaatgtttttgttgtatttccttttgacacttggaattttttaagataaagttataaatttaaaattcaccccttttagcgtacagttgtatgatttctgacaagtgcacacaattgtataactaccatcacaattgagatatagattagttccatcaatccagatagttcttttggctcctttttcagtcagcccctctcctcaccctcatctctggcagttactgatctgttttgtgtacctgtaattttttttttgtcttttccagaatgttgtataaatgaaattatacagtatgcagctttttagtctgatttttttccacttagcataatgcatttgagagattcctctgtgttgtgttagtactttactttcattgctgagtagtataccattttgtggatatatcagtttgtttaccaattcacctgttgctggacttttgagttgtttatgtttttggccatt

SEQ ID NO: 14816 - DNA, 1133 bp, Homo sapiens
aaaaatattttctgtttacataatcatgccatcttcagatatagacagttttattttttaccttctaatacatttctattttattttttatttcttttcttttttctttttttttttagagacagagtctcgccctgtcaccccagctggagtgcagtggcgcaatcttagctcactgcaacctccgcctcccaagttcaagcaattctcatgcctcagcctcttgcgtaactgggattacaggtgtgtgccaccatgcccagctaacttttgtatttttagagtcaggatttcgctatgttggcctgactggtctcaaactcctggccccaagtgaacctcctgcctctgtcttttattcctttattatagaatttttatttaacatgaagtttatttgtggtgaataaaagtgcttcacattctaatgttgtctgcaaacttattctgtgtttgcagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggtcagtaaactttatatgactactgagtattatgttgaatattaagtaacatcattaatcactttaatagttttactgcaagttatttttatgtattttccccaattcctggtcccctaataaaccattaattttattaacctcctgggtatattggtaatttgttggttgatttttttttttttcagttttcctctataagattgataggatatacttctctctggaatcaatatgaagaaaaattgataatggcccttgagcagatagtttatgaacataactatcttaactggttgtgttttcttctttgctatacttgattgcaaactcagaacccaatttcagccaataaaaagtatataatatatcattgtgattttgcttttaggtattagccttcgttatggctttactattatttttattcctcaatttctttattttgtttttaaccctttattgacggaggaggtattt

SEQ ID NO: 14817 - DNA, 1147 bp, Homo sapiens
aatcttggattttttaatacatcatgcataaaaatacagaaggaacaaatttattactatctattatgttccaagcaggggaaatatttaaaatgatcacactggtactatcatgacattgaccattcagaaaagatgctggtccttggatcatgagagtacatcctgactgaataacagatctggtcctagacagtttagtgttttgtactcaaatttattttcagtcatgtcttcatggtagacattgttttttccattttacaaatgaaaaccctaagacttaaagagataagtaacttatgcaagatcacatagcaaattagtagagctgggattcaaattagttttatttggctctaaattctatgccattttcagtgttctactgccttgataaacttaaaaccgatctgctttctatccagaactgagttcacaataatttatcactcatttggaagaacagatcattgtgctgattttggaatttcccccaagataagctacgtttctatgaatacttactaaacttttttcttccttattctatattaggacgtcttgcatggctggtatacttagttgggacagttgtaggaggaagattaacatataccagtacagatgagcatgatgctatggatggagaattatcctgtcggtaagtaagagctatgtaatttactgaaattcactaaatagttaaaaaaaattagttattgaactagtattatgagtgaagacattttgtatgtggccttttgaggaaggtattatttccctttttattggtgagaaaaccaaggctcaaaggttaaatgatttgtagaagtcaaatctctaataagtgatagactcaaaatattttgtacatgtttgtgcaaataatgtgataaagatttaggttgctttttattacttaggatgtgagcaagcacatacagttggtgtgtattggaaaggtggcaaaattgggtgacatacatccaatcagaaagtattaggtagtcagttacccatcgcaggttttgtcacctattggccacagtcttaggaaaaagcagttgaattattctcttcaagtttctattctaacctgaggaaaatttctatatatgaataatacaagtgaattgattttcca

SEQ ID NO: 14818 - DNA, 1233 bp, Homo sapiens
aatacctcccaagaagttcatcacaagattacagaaagaagatgagctttttgacaactacatgcaacaagatcccccatgaattcttaaattacctactaaatacaattgctgatattttacaagaagagagaaagcaagaaaaacaaaatggccgcttacctaatggtaatattaataatgaaaataataacagcaccccagacccaatgcgggttcatgagatttttcagggaacattaactaatgaaaccagatgtcttacttgtgaaactatgagcagcaaagatgaagattttttagacctgtctgttgacgtggaacaaaatacatcaattactcactgcttaagggctttcagcaacacagaaaccctatgcagtgagtacaagtattactgtgaagagtgtcgcagcaaacaggaagcacacaaacggaggaaagtttaaaaactgcccatgattctagctccacacctgaagagatttaaatataaggatcaacttcatcgatttacaaaactctcttaccaggtagtttttcctttaaaacttagtctatttaacacttcaggtgatgccaccaatccagacagaatgtacagccttgttgctgttgtggttcactgtggaagacttatttgtagacttgcttcatatgaaagtgtggagggtgtgtgcagcctcattgtcagcattggtcccagtcgaggccattgtattgtaatagttaagagtcatgatttttggttgttgtttgatgacgacattgtagaaaaaatagatgcacaagctattgaagaagtctacgggctgacatcagatatctcaaagaactctgagtctggttacatccttttctatcagtctcgggattgagggggaaccgtgatgaagagatactttctgccgcatttcttctctggttattttggaaaggatcaagcactgatttttcaagaaaagagaaaatgcaggaagctctgggggcagtagcacactttgcacacgataaagcaaagacgatggattgacaagcccttccgatcacagtagttgatttatttgctcaggtatcatgctgtctgtacagttccattcaacaaggaggtgaaatcagagataccagttcctcttgtaaaacagccttccagtattaacatgcattttctctttattaattgcaccaataatgccatgaattccttgggggtgcagtagaaagaatcggaat

SEQ ID NO: 14819 - DNA, 1236 bp, Homo sapiens
aagtggggaagctgggatgtttaaggatcacacatactgcacactcatcccacagtggatgagaaccagatttgggactctgcctccaagactgccggagtctgccttggtgagggacagtgggattcttgagaacagacctggagttccacgtgggagtggaccctgtagggacatcctgtctcaaggagaaagcatgcacagacacacaaacctatggaggccatgtgaaagacgactaatggggctgctgggtctaatcagatcacacgtggatccaacttaactcagagtgaacagcaggaaaaaatagtgctggcagttccaaggggcctaccacttcacaaatgtgctccaagaggatgagatgggctgctgtttgcacacccgcccttctgatgggattctagtgtacagatagatggatggttcatgcaatgtgggtgccaagtcaagccagctgcttcagggatgctcaagcaagaaacagtcggaagggatttttactttgctcaatttttgccttccacactgacttcagaacctggcccctgagaaagatgtattctgcctgtattccggatgtttctgttattctgttttccaatcaggcttctttaggatgggggacaaaggagtgtagagtccctgcactgagtgtgattatccgaactgcgcagaaaaaccctcctagccttctggactcccttctattggccctgacaacctagaagtacctacggattatggtagtgggggcccctttcaaaatgcaaaagtggcttgccatgtagctgttagctgagattagtgaccagattagctgactaccaacagctgcacatgagaaccaaaaacagagtggatttggtgagaaaaattgaagaaactgaaagatctggcatatgggaaacccgatctagatgttcagcagttttggggaagtcctatttgagagaactcagctccttatgatgaggagggaaaggagtgcctgaagagaaaagcagggcagagtaaaaagggagaaagtaaatgtttgttttttttgtttttttttttttgttttaagacaggatctcactcttgtctaggatggaatgcagtagcatgctcacagctcactgccgcctcaacctcctgggctcaaacagtcctcccacctctgcctcctgagtagctgagactacaggcccatgccactgcacccagctaatttttgtattttttgtaaag

SEQ ID NO: 14820 - DNA, 1301 bp, Homo sapiens
tctctggcacctgaactttggggtaacgattaactgcgatccgaagccttcaggcaagtaaaaaattcctgaagtgattacgcctgtttggaggcttgcagggcactaggggatggggaaaggtgaatcgaggtgctctctggctcattcgcagccggctaacccgccatatcttacacagctaagggctgccgacgccattttgcagggtgggctgcgcagactcttggcgggaggccggcgcgcttgagcgggagaggacgtggaagggttggaggtggggagtgcgcgttacgactggaaagcacgcgtgcgcacaggcgacagcagcggaggggtggggccagtgtacgagtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggtaactgctggggggagctggagcgaggccgagcggggcctggtggcggtgagggtgggggtgaggggcgggaatccggctgcaaccgggtctggtggagaccgccagaccgacgggaggcctgagcgggtgggaagagctgcctgagccctggacctggagggattggagccgcggggggagccggtggcgtgaagggggaggagacgagcggcctgaagcgtctggggcgtgagcggtccgaggcccggggcctgaggtaaagtggaaccggccgcctggaagttcggcctttgccggggatacgtggcggagctccaggcgtggtttattttctaacggcggtggttcataggcttctgatgccaggccccgggttggtggtcctggaggctgggttcaccgggaagcatgggcctgcttgttggagcgggtagatgcacagcctggcgttattctggcctcagagcctggagctgccggacgtagacttacctcgcgtgcttcggccagttactgggggtggggaggcgcggcgcggcgtgaggaggccgcaaccgctgggagcacgtggttgccacgtggttgg

SEQ ID NO: 14821 - DNA, 1546 bp, Homo sapiens
agtggtgtaatctcggctcactgcaacctctgatttccgagttcaagtaattccctgcctcaccctcccgagtagctgggattacaggcatgtgccaccacacctggctaatttttgtgtttttagtagagacgaggttgttaccatgttgtccaggctggtctcaaactcctgacctcatgatctgcccgcctcagcctccctaagtgttgggattacaggcatgagccaccaagcccggccctttcctatgcttagatgcacaaatactgtgtttcggttgcttacagtattcagtacagtaacactgtacaggtttgtagcctaggtgtgtgtagtaggctataccatctaggtttgtataagcacattcttatgattgtacaaagatgaaattgtctaacaacacatttctcagaacctagccctgtggttaagtgacgcatggctgcatataacatttagtgggggggtgtaaaataggtggaactcaaaagttgaagtagtattttttttttgttcacaggtcagtttaggggctggtgcaaaggatgagttgcacattgttgaagcagaggcaatgaattacgaaggcagtccaattaaagtaacactggcaactttgaaaatgtctgtacagccaacggtaagggcacttacatactttggatgttgtgtcaaggtttaattctgttttaaggtaggtttggtgtcatttagttgtgccaaggagatagaaagtggttctttatcttctgtcactggagttcgatggtcaactcttgaacatgggggcttctgctgctacttttatcagaggtggaaaaacaggttcactggtttgttgatttggcttatgtgtttgcctgtaatgtttattgttcattttcttcacatgtttagtgatgaaaaatttctcccttctaggtttcccttgggggctttgaaataacaccaccagtggtcttaaggttgaagtgtggttcagggccagtgcatattagtggacagcacttagtaggtatgttatttttatatattatactacttagtttgtcctctttagtgcagttgcttggttcccagtttggacttaaagcatgggtatagtactactgtctttttaataggttccaatgtgagtctagaaattggagaggacaaataaatttttggggcgggggggagaggaaatcttgctgtcacccaggctagagtacagtggcacgatcttggctcactggaacctctccgggattcaagcgatcctcctgtctcagcctccccagtagctggggccacagacgtgcaccaccaagtccagttgcgtttcatagttatagtagagaaggggtttcgtgatgttggccaggccgatcttgaactcctggccttaacgtgatctgcacgccctggcctctcaaagtgctagtattacacgtgtcagccactgtgcctggcctaaaaattattttttaataaagacagtctcattataacggctggagtgcagtgatgtgatcatagcttgctatatcctcgaact

SEQ ID NO: 14822 - DNA, 1092 bp, Homo sapiens
ctccacgcctggctaattttttttgtatatgtgcagatggggtctcagtatgttgcccagattggactcttggcctcaagtggtccgccttggcctccccaaagtgagattacaggcatgagccaccctccccaggcttcttgcatttaaaacctggcagtgaacattaggcctcaaaatacttttgttaaaaagttccttttcccatgtgctctttttttttttttttttaaatagaatagaagtctcagtttttagagtatttactatcagtgttctttttttttctgacttcttgctgcttgagttttataatgtctaataaattgtattttagctgtggaggaagatgcagagtcagaagatgaagaggaggaggatgtgaaactcttaagtatatctggaaagcggtctgcccctggaggtggtagcaaggttccacaggtagagatggcaattttattataggttttgtattatagcttttagtttggtgatagaacagctcttgttcatgagtacgtatcttttcttttaaaagaaaaaagtaaaacttgctgctgatgaagatgatgacgatgatgatgaagaggatgatgatgaagagtaagtatgattttagaaacttgatatacttccggaatcttgacaaaaaaaggaatttgacatagttatatgcatgagggttttataaaagtcatttacaaaaagccatcctatgtaatagtttataataaaagggcaggtggtcatctgttgtcagtttaagttaaatgagctgagttgaaaggatattgggtctgtgagcctttacaatgctgtgacttgtgactcttcagaagggtagactatagtgtttgtgaagtttgattatgtccctttgttctgaagatttagtggatgtgttatacccatcaagcctggtatgttttatggtgagcagttaatgagattgggttgaaagaaaatatgattaaatagctctatattcattttacaagttgttactcaaggtttgttattccctaaaaggattttgtcttatggttttatgtagatatttattgacaaaaataagattctaaaagggat

SEQ ID NO: 14823 - DNA, 1401 bp, Homo sapiens
gagctgaagtgatctgcccgcctcagtctcccaaagtgtagggattacaggcgtgagccaccatgcctagcctcagcatatagttttttctaaatgtacacatgcccaggcacacatgcacaggcaattcagaataagtttctggtgtttatgtaactttatttgccaaatctggccaactctaaagctgatctcgggagatgaagttggaagtaacattggccatatgggtctctgttctttctgttgatttccttaagtaaataatgctaaactattaaataattattagtatattgttcacatttttatgactgattaaagtgtttggaattaaattacatctgagtataaattttcttggagtcatatctttatctagagttaactctctggtggtagaatgaaaaatagatgttgaactatgcaaagagacatttaatttattgatgtctatgaagtgttgtggttccttaaccacatttctttttttttttttccaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaaccactttttcatcataaggatttagtgctgtgttcccacctcctgatgatagttaacaattattataactatgcaacatgtttccaaatgttccattagacctcctatctgcctattctagcctcacttgcaaagaaaatgtggcatgttaaaacagcttaaaagcagcctttcaacctgtatggttttttcccctaggctggagtgcagtggcacaatctcagcttattgcagcttctgcttcttgggttcaagcaggtctcctgcctcagcctcccaagtagctgggattacaggtgtgagccaccagcccggctaatttttgtatttttagtagagatggggtttcaccttgttggccaggctggtctcgaactcctgagctcaagtgatctgcccacc

SEQ ID NO: 14824 - DNA, 1311 bp, Homo sapiens
cttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctgacgttctgttaagaaatttttcaaagaaactgttaagtgctgttaggaattcagtgacatacaattaaaatttatagatctttagaatcatctgttctgtaaaatgagtttgaaggcaaactggttttggcgtgtgagaatgttgtagtagatgatatgattccttgtcttgggcttttgccgaaagctagcttgaacttcaggagttagctgagggctagctaagaactcttgccctgcaaatctgcttcccacacataattaattgcttcacaagttactgtcaacatgaaaatggcctctgagacatcccaagtggctttcaggtgtgagtggatcctccccttcttgaagaagggccatggaggtgtgaggggcagtttcgcag

SEQ ID NO: 14825 - DNA, 3719 bp, Homo sapiens
cctcgggtttttctccagtcatttggctgttttcctgccaggggatttgcatctgcttttttttcctccctgccccgtctagattgacatttcccccaactgtacccttcagtccacagggagcttctgagtggcggtggcaggaggtggtacttacctcctgtgggaggagctctagggtaggaaatagggaagccgtagtttctcaagcactgaggcctggaagggaatgttccagagaaggccatgtcagtgggggtcctgtgagtgggagacccacgtgtggcctgcagatctcaccaagtgccatccatcctctctcttccctaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagtatgcgggtttacttacaaggaaaccttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaaattctttgagacagggtctctaatatgttgcccaagctgatctcaaactcgtggctcaactgattctcccgcttcaaccttgagtagctgggacgacagatacatgctactgcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgccgttcaggttgttcttttggattggggtggaaagcagggcacacttaaccatactcacccggcaagaaagggcttatcttccaagtacgcaggtgcctcccaggtcatacggcagctcagacttcgggtttctctttggaaagacattatgcttggctgagagagagcatgtcatggggcatgttctctacagacatttaatatcattctcatttaacaacaaacattcattgaccccaaaaagttttcacctgttaatgtactgaatcctttcaacaatcggaggaagacaccatcattcccattttatgtatttattatttttttagagacagggtctccctatcacccaggctggagtgcagtggcatgatcatggttcaccgtaacctcaaactcttgggctcagatgatcctcccactttatcctcctgagtagc

SEQ ID NO: 14826 - DNA, 1288 bp, Homo sapiens
ggtcatgagggtgtgagtgctgggccagggagctcctgcgttagcttgtcagcagctaggagcccttgagggttcaccctgagtgtttctggttgaaggccacggagggaaagaggggaaggagggctggcacactgagcagctgggcgggagacccctggcatgacaactttggtgggctgctgagggcacagagcactgggcggagagccagagctgagctccaggcctgccagtgcctcctagctatgtgacctgggacaagtcagtttctctgcctgggcctcccttttctcttccataaaaggcgatggtggtacctctgtgtacttcatgggcctgtgctggagaaaggcgggctgctcgttgccctgcagcaagagaccataagagggtttgacaggcctttttcatcctgagcccgcaaggacctgggcctcccaaggcccaggcccgtggtgcataaggctcctgtcctctgctgactcacgcctgccagccaggggccttagtgggctctaaactcaagcccatgtcagctggccaccccggctctgtgtctgctgtcctcaggtcaccccctttggctttatgttgggcccttttcctgcacatagtcagttctgctgtgaccgtggttttctctggggccagattttctctctcctaaatagagtcgcagcccttcctgcgattgaccgccttcatcaccatgcaaagattaactgtgttcaggcagggacagcacagctgtacattgtgtgacacccagaccaagccctgctttggttccagtggcctgaaccatatttgatacatgcctggcacggccgtccagaataaagacagggaaataggaaccctgagccctgactgctccgtcctttggctctgacccacacccaggcttttcatccgacaggtcagctgggagccttccctcacacctgccactcagccaggttgctaggagacttccgtagcaaatgatcattgggtggggttcctctgctgattccttgcacatgtccccttttgcttcctagaaaaagaaacccatgtttcagaatctgggtctgggacagtggagtgagttttagatgctcccttacctccgaagaggcattttctgccagagagggctgggggtgaactttctacagtgatcgaagtgttctgtatgtacctgctctgttcaatacggtagccacagtgtggtggcacgtgaaatgtggctaatgcaactgaggaactaaatttttgcttcatatctattaatttaaatagc

SEQ ID NO: 14827 - DNA, 2034 bp, Homo sapiens
agctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaagatttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaa

SEQ ID NO: 14828 - DNA, 1125 bp, Homo sapiens
tctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaa

SEQ ID NO: 14829 - DNA, 1116 bp, Homo sapiens
ccagacccctcggctgggctcaggtccctcagctgggatatttcgtgtgccagaggtagcagcctcagatggctttgtcagggttcagactctccttgctatttagaaaagatgttgtctctaagaagtcatggagaaaatgaatcactgtaaaaatcaaattttcttatccacttgcattattggtttagagatggcttctctccaagataagtttttggtagactgcagatcaaaatgtttaggggcatctgggggtgtcatgagaagagccccagatgggacacccgttcttccttgtgacattagggaatttggtacagctttctggatcagtttttgcctttaagatgcatctggactcatcaaacccagaaagtgtagagcaaatattcctattcccatgtccttggcagacattgctaatctatctcagggctccaacagagttgggtctcagccttaccagcctggcagccactagacttgatccctgagatgaaacctcttgaccacacaggaactccatgatcttgaagctcccttctggctctataacttttatgtctctctctctcttcttgctgtatctttcattctactgactattctgatacaaaaatacttcacgttcaagatttaaggccaagttcacaaactgataatactcaggccaaatctgacccacagaagtgtttcctttgctttgcgtattattttatttttgaaacacttgccatcattttttaattggtgattttacctaattccccagatttctggtttcacttaacgggctgccctcggaccccttggttccagccatgtgccaagctgggaggctttctatggactccacagtttgccacaggccacacccagcccacttctctaatttccagttcctgcctattctcagtaggcatttttctactccagacaagtatacttctgtcccacatgtaaggcctggctgtctctcatttgctgatgtgagctgctagatgaccaacgctccggtctgttaactcacttgggatgctgacgtttcctggaatctctttcagagggaaaggtgtttcctctctatgaatcataactgcctgatgaattagt

SEQ ID NO: 14830 - DNA, 2928 bp, Homo sapiens
gtgataaattcagagttgaggttaagaccacaggctccagagttaagacgtacctgtgttcaagttgcatctctgctagtggtgaacttaggcaagtcacctgatgaacctcagtttcctccgctgtgaaatgggtctaataattcccttcctcattcagagggtgaatatgggaattaaaggagctcataatggtgaaaattattttattattattaaatccaccatccaacaactggttttctttgagccctaagtatgttccggacttggtgactatgtagtgggtattatgggcttaacgggcaatgtctgccttgcagagcccatcatctcatgatgtgggaggggtctggcctggttcatcctccagcactgacttctgacactcccaccccacccctgccctcttgcagatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaatattatggtgtgattctttctaccttgactggggctgggtgacccaaaggctggaatcacagccagaatggaattcacttctagaggagagaaggtagaagagttgaaaaggagatctgtgaggatgatcagaaagtcaaaccccggccaggcacggtggctcacgcctgtaatcccagcactttgggaggccgaggtgggccaatcaggaggtcaggagatcgagaccatcctggctaacatggagaaaccccgtctctactaaaaatacaaaaaatgagccaggtgtggtggcgggcgcctgtagtcccagctactccagaggctgaggcaggagaatggcatgaacccagaaggcagagcttgcagtgagccgagatcgtgccactgcactccagcctgggcgacagagcgagactccatctcaaaaaaaaaaaaaagtgaaaccccctttggccaggtgcagtggctcacacctgtattcccaacacttttgggaggcagaggcgggtggatcacctgaggtcaggagttcaa

SEQ ID NO: 14831 - DNA, 1176 bp, Homo sapiens
cctcaagtgatccgcctgcctcagcctgccaaagtgctgggattacaggcgtgagccaccgcacccggcctggggctcatgaacttaaagatcatggcccagtgccaggcacacgggaattcagaatagtaagggacaactattgttaagttctctatgtctgttgcataagtagatgaggctgtagataactacactctttgtctaaaagggccaagttctcatcagaacactttgctgagccccgggtgaccgaatccctagctctggggtgagcgacatgcctccaaggagctgcagccaggagacagccaggcgaaggcggggctctgcctctgggctccccgaggggcggaggccggcgcgcgggtcacgtgggggcgcgggaggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccgggggtaagtgcgtgaggcccgccttgggaggaacgggcggtgaggagctagcaggccggggcggggaaaggcacgacccccacacgggtcagagaacgttgcatgggcgccccccgcgctgcagagtcaggcccccgacccggcggaactccttgtgttccttttcgcagcagcttcagtgtcctccggcctgagcgagtggagggtgacctttggtggaccccccttggaaacgagtttcaggggaattttttctcatcatagtcctgtgtggggaggtgcagtcggaaatgagcaggccgaatctgggagaaactggggtttgtccctagtcgactgtccccctttagccctgccttccacccacatgaggcctcgtttgcctgaacttaaggatcaaataaataaaacagaaattggcttctctgcctcccatgctgtcgcggttgcgtacagaacaagctccttcgacaacattgagcccaggccttgcatctagtgggcgccaggaggcggttggggcctgatctaaagcgagattaattaccaaagagcaggaggtattgttgagaaacccctgcgtcatg

SEQ ID NO: 14832 - DNA, 1364 bp, Homo sapiens
gggcagcctccagtacaagaccaatgcaaggagcccgctccccaggagcctggccccagagcagagttcgccatgcctgcggaacctcccctccatgctataagagggaagggaaaaatacagactcttgaaactgcggtgaattcattagattccagcacaatcaatctcagtcagcttcattcttcctgctttctgtaacatagagtgttacttgtgctcctcatttcagcagtgtccttggttactggaccttttgccacagccctgcaaaacctggccaaacttgcaccaagttgattatcctgtgtttcatattttgttgagcatctgtgcattttaaagtgttggcttggttaactttctcgatgttaactttttgccttcctgaggaatgtatgaggaccagttaccagaatggttttgttttgcaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgatta

SEQ ID NO: 14833 - DNA, 1173 bp, Homo sapiens
caagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaa

SEQ ID NO: 14834 - DNA, 1866 bp, Homo sapiens
ttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtg

SEQ ID NO: 14835 - DNA, 3124 bp, Homo sapiens
aatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaaga

SEQ ID NO: 14836 - DNA, 3062 bp, Homo sapiens
ttgagaagaacacttcactttgaaccttacgggctattttccagactgtccaaatatgatttgtttcctctcaccatcatttccagtaccctgtcccaagtgtttgaatatagacattgatatgccctgatttttgctctacttcagaaaggatcggggatgtaatttagccctctaggagcttggaactaatttgtttgtctatttcttgtttgcttccaagttgcttattatgtgttacaggtagcaactacagctgaaggccatggtgaattgctggtgatgtaaatactcccagccctgactgatcggccttgtttaaattttaaggattagtaaacaggttgctgctggagctacttctgcttaggctattaggagaataaatgttgaaggaaatggagtccaattcggggcttactggctttgacagtacgaggaagcttttcagtgccacacgtgtcaaactctttctcaccatgctgtcatttgtttgttgttttggagcaactcacttagttttgtttttgattcttttgtacaaggttgggtgattgtgggtgagattgtgcagtaggaataacagctgctggttgagaattacccctcaaaagtgaaaatagcgtgagctgtatatggtaagtggattgacctctaaactccctagaagggctgtagctttgaaggtggacatttattgggctcgcacgtgacacttattggggctaaagatgaatcccgaaggaactaaataacagaatgatctgtttgtctccacaaggtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaaggtccagtatcctatcttctgtccaggagtatgcatctctggcttgtagatatgtaaaatggataggaatggggtaggccgtaattgaggatcattcaggaagtatttactgcagatggacttcacctactgttataagtcactttttactgagaactaattagtagcagtttcctgtgtcagtgactgattttctgttccaccagcgctaaacatgtaagctatggatagatgcttcattagaaatcagctgggatgattggtgtgcataaaggggattcaaatgaaagtcttattttgctgaaatgtttaaatgagtctctcctggacatgagttaacttaggcttgcaattttatttaaaatcaagcagtgccttctgaagtgatatcctaaatgggattcagagtctgctttgagtgcgactcgatttccatgaatttagaaggagtttgtttaccactatcaattaccatgggattcttctgttaggaacactccccctttttaaattaaatttggaattaaatgtaattttaaacagctgtagatgtacaaaagaatgctttttgcaggttttgggagacattagtaggagcagcgatgaagttagcagtggacttttcgccgttgttggtgactgctgggatatgttttatcccttcattctgatttggtgttctttttaagattctctgagatgcctgttataatcagtaagtgaggtgaattgactagggcgttttgagtgtcagtgatgagcaacgcaagagcatcaggactgtctttttgttcctctattgagagaagcccttgagtccaatatggagtgtaaaacattcattttaagtctttctttttaattgtaaattcctttaggaacataaaagtgaatatagtctgttatcaataaataacattttgatatgattatctttcctttttagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatacttttactccgaagcttcagctgaagcttaaacctcaggtctgtgaagggcaacctttgtcttctgcctctgtgcaccacacatgatctactggcagtgaagattggtacatataacttggaactatgaaactagtaggtgtagctagtagtgggctgtttctctcctccctgagccattactgacactggtctttagttgaggtagtccgtggtatgtgtcagtgtttgtcatccttgtgtgtgcagaagtagcacctggggatttaagggaaaatgcatatttctgattaagaagttctggggtgggacctaagagtgagtgtttctgacaagctgccaggtgatgctgatgctgccaggcctctgaacat

SEQ ID NO: 14837 - DNA, 1104 bp, Homo sapiens
gctggtgctggtgttgggaaggctgctgcgtgccaggcccaggtcaggagctgtcacctgccctctggctgacagcccgatgcagctgcactccagtcagggtggctgtgttgctgggcaggttgggagcagtttgctgaatgacccctgactctgtctctttcttccccagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagt

SEQ ID NO: 14838 - DNA, 1233 bp, Homo sapiens
acctgcctggctctaaatccctctattatttcttaaactagttcaagtcatatggctttcttgttatagtgcttatcttcagctgcatattttagttatatcttccaataagtttgggaagagttgtcaccagtaacacctaccaggactgtggtctgtgcctgactctgtgtacgaagtgctaaatgttcacccatcctgacagcccaccagaggcattgcagagggcagtgtgcctcaggccacagctctgaagagaggcaagagcatctctctctctctctctctctccccactccaaagcccatactcctgcaaccacacttagctacaaggccttagaagcttgcatggtcccagcacacccatgtgggaaatatacaaatactgctaggaaaagttttgaaagcattcttggcctgagtttctatgcaaatgggactctgcatttttcagagttttcaagaagaaataagttatttccatttactagtacaggaaaaataagataaagctcttgaaattttctcctctgcagcatgtctcaccactgataggacgttttgttccctttgctgccgtagctgctgctaattgcattaatattccattaatgaggcaaaggtaagacgaatatgcactcttagtagggacatgtgcttgacaggagagtctcttgtaataattagctttgttgaaactttcaaatgcttgttttaatatgtataggtgaaattatatgagatcttggatttcttttgaaatactctggggttggggatgaggatgggcgtcttgagaaaacaagcttagcgatgagttactgattattgaagcagactgaggagtgcggggagggggctgatgctggaatagtctttctatgtccgtataataaaaagtttaaaagatatatctcaagcttacattgagttgtgcttgggttggacaaagtctatccaaagaaagtttattctctaaaatagattccttttttttctccagaattttcttttggggcttaaagtacattattctatatctttggaagtattgttgtagaactggcaaaaattaaaggagaagaaagaacaacaaaagcattttggaatggataacgaaaaacaggggtaacggtagaagttatacttagtgttagtaaatatagttaataaatatacagtagggccatgtgcgagtgactgtttccatgtcagcatattaagtttgttg

SEQ ID NO: 14839 - DNA, 1212 bp, Homo sapiens
ttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgccttgtgtctgtgtttctcttttctctgaaaggattaatagatctgaagctttgggccactcagagccttccttgatgctgccagagtcttcttatttagattttctgtcttaaaccattggaagcaaaacggttttcccatgacattctggccttggacagattctgttgtcctcgacgcgtctctttataaagtggtaaaagcctgaaattcagggcagctctccatgaggtgctgaagggctcttttcataagaagctaaggcactgctgcctgccccaggtgtcccgctcctctcagagtcctccccctaccaggtagtgtgtagctccatttcagaatgttaacctccagtgaagagctaatgactggttagaagattgacaaactaaccaaaattttacacactccggttatgtgtgtgaaaggttataaaaggaatggccgggtgcggtggctcacccctgtaatcccagcactttgggaggccgaggcgggtggatcacctgaggtcaggagtttgagaccagcctggccaacatggagaaaccccgcctctactaaaaatacaaaaaattagccaggcatggaggcacatgcctataatcccagctactcgggaggctgaggtaggagaatcgcttgaatccgggagctggaggttgcagtgagccaagatcgcaccattgcac

SEQ ID NO: 14840 - DNA, 1163 bp, Homo sapiens
cagaagtcaggggaaggaaggagcctgtgtccctgggacgacagtcaactggagctaggtgttgacctcagaactgcattttatttattaatttataagcagaacaggccagagttctaggctctgtttctaggtgctgttttcaaaaccccagatgacagtcatagaaaatttggaacttaggaaaatagctggaatcatgaatgacaatgagataacatacagatgtcagtggagacaaagttgtgggttcctcctcccacctggctttgaggctgtcgtcgatatcatagtactttacatggattcacatgaactgaaacgccaccacttggcccaggatgttgaaagggtgcaaattccttctgggtagataagaaatgactctgggagaggatttcccttatgtgaatctaggtaaaaagatggaaaaaaattgtattatgtgatcctaaggacaggaatagcagaccagccaacgggatggccttgggtacatcactcagcctttctggacccaatttttccccagtgaaagccaagttggactgaatttctggagttctcatcagtgcacattccatagttctccagtgcttggcgatcagcccaattgaaggactggctctgtactgacacttattatcggtacaggcaaagaggagcctgttgtctgttagggaccactaaatcaacaaccacaaatggattttttttttaagaggagctgtgcacctcaatttgctgtctagttgagaatagagattgtgtgccttcatttcatttgacatttacccagcatgcctcagttccacaccgtgaccagtgtaagaagaggaactatgataaaaacagttcaacaagccgcaaggagggtgggaaattctgaagtccagaagcgagtgtgatctttggaatagtggctgctgtgcccttgggcgccatttgaagaatcactgttcttgaaagtgctggttcactttctgcagtaagaagtgatttatgggcttttatgtaaaattttaagaatgacttgggtttcagagtagcctttgaaactttgctggcagcttttcattttgtcattggaaggctaagagacttttctcctttgttctatgaactccttgttcttcagggcttgaaggcaaaaaaaccttaga

SEQ ID NO: 14841 - DNA, 2245 bp, Homo sapiens
tggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttctgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgctgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttcataacaggctgtggatctttctgtgtgggaccga

SEQ ID NO: 14842 - DNA, 1587 bp, Homo sapiens
ccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgctgcctttggctgcccgtgtctttttggtgggaggtgggatggggatgaggcttaacacctgtaatcccagcactttgggaggccgaggctggtggatcacttaaggtgaggtgttcgataccagcctgcccaacatggtgaaaccccttctctactaaaaacacagaaaaattaggccgggcgtagtggctcatgcatgtaatcccagccggtggctcatgcctgtaatcccagcactttgggaggctgaggtgggcggatcatgaggtcaggagattgagaccgttctggctaacacggtgaaaccttgtctc

SEQ ID NO: 14843 - DNA, 1105 bp, Homo sapiens
tctgggtgggggtgatggggtgtgggatgatgccagccggcatggaggaaatggggtggcacggctatgggggtggcaggattcccctcctgtccctgcactgaagagaggagggctttgtagaacctctggggcaagtgtgggaggcctgctgcagacatggggcccagcggtctctgctgccacagggcttggcccagcgcctgcctctcaggtagtctggaggaagccacagtcattgaaccagtatccttgtcccactccctccctttttctagcctctcttgggtcggggaagggggagctcagtgtcccctcccttgcacccctctgcctccaccagcctggaggttgggcccaggcctgtgggggtggggaggtggccacccacttggctgtcccagccctgtcccagacagccctgtattcctgcagcctgggcttgttcccaaacagggtgaggctcctgggatgggcctggctcacctggggctctcccctgcccccacagtggtcttgctgcggagcccgaggccccaatgactggaacctcaatatctacttcaactgcactgacttgaaccccagccgggagcgctgcggggtgcccttctcctgctgcgtcagggaccctgcggtgagtggggctgggggaggagaggtaagggactttccagtgcacagactctggagaaacctcccacagggccccgctccgctctgccctgctctgggggcgtggatgctgggggacgtcattttacatgggtggcactgaggcctgttggggcgcggctgctttccctgttcagcaagacctgtcttttttatcgtagtgagatggaaacagcaggaccctggggcacagggatggggactggcctggaggcctccctgcaccctatacctctacataaacacagccgcagccattgtctgctcctggccagcttgaaggttggccaggctgtcactctcagttatggttgtatgtgacgggggttgcctgggtcattgccagccagcaccccactgggccaccgttgcagggtagcagggagtggggacctctgtccctttacgactttcttcagggcagaaacct

SEQ ID NO: 14844 - DNA, 1156 bp, Homo sapiens
taaccccaacactttgggaggccaaggcgggcagatgacctgaggtcaggagttcaataccagcctggccaacatggtgaaacccagtctctacaaaaatacaaaaattaggctggatgtggtggctcatgtctgtaatctcagcactatgggaggctgacacgggtggatcacctgaagtgaggagtttgagaccagcctggccaacatggtgaaactctgtctgtactaaaaatgcaaaaattagccagtgtggtggcgtgtgcctgtggtcccagctactcgggaggctgaggcaggaggattgcttgaacctgggaggcagcggttgcagtgagccaagatcgtgccattgcactccagcctgggcaacaaagcgagaccatctcaaaaaaagactaagttgaatagcttctagaaaacttatactttaagtaaattatgatctttttattctagacaaaattattgtccttttattctagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggttagtgaagtagagctgaaaagtagagctgtagctctcaaactatgcttctttacccatggggagtttgtttcgtgactgacttcaccttaatgccagctcaccaaaaccatgaaatttttactcagctttgttttaatttgtaaatggaatgaagaattacttaaggtagtaatcctgttgcttggttgaggatggatcatagttcttcagttttataatatagtaatccaaagtggcattttggaactatttgaatcatctaaatcaattgtaaatcttagttttcatgtgtctagaaagtgagaggaaaaacacgtgaatgttcttaagtctcttgatatgttctacatataatagcacctagccatctgtagctgtttaaaaataactaaaattaaaaatcagcttctctgttgcactagtcacatttcaagtgattaaagacacataaggctagtgtcagttgtattagacagcagagctatacaacatttttatcattttagaaagctt

SEQ ID NO: 14845 - DNA, 3094 bp, Homo sapiens
tcagatgctgcttgagctcaggtgctaactacctggctggttccataaaagcaggaggcctgacaggtttgtaaaagcttctgatttcaggccgggtgcggtggctcatagctgtaatcccagcactttgggaggctgaggtgagcggatcacttcaggtcaggagtttgagaccagcctggccaatatggtgaaacccctattctactgaaaatacaaaaaattagctgggtgtggtggcgggtgcctgtaatcccagctactcgggaggctgaggaaggagaatcacttgaacccgggaggcagaggttgtggtgagcgaagattgtgccactgcactccagcctgggcgacagagcaagactctgtctcaaaaaaaaaaaaaaaaggaataaaaaaaaaagcttctgatttcatctcccttttcccccacccatttctttgataagtgataattctttttctcctttaaatttaaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtaaggacatctaaatgtgataaaaaaaaaaaaattggagaaagtgctgataaac

SEQ ID NO: 14846 - DNA, 1105 bp, Homo sapiens
tcctctggagagggtagagaggttcgttcacttgaaaggctttaaaagaatcacagagttccaggcaagcattattgttgtctcccctctccctatttattctggggctgatttcctagttgtcaggacagtggtttgagttgggctttcccttgttgaagcaggctcactgacagttacgggatttgattccttttggagacttatcacatagctcccatctgagttttcttgatggatcgagtgtttaagatccatcatcttagtggtcattccttctatttgtgacattttttcagtgctaacaaatagacttgaataactcacattctttttatatttaatatttttgtttttcttttgcttgtccctgattttcctgctttaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggtaagaaatcatttcttcctctatttgtagtctaaaaagggattaaatcaatgttttaattggaacaaaaatacttttcatcatattgccactggaaaaaatattagaaatgatactattcatctgccattcaggaaatgatgtcccgaattaatgattacatagcagaactttttttttttttttttttttttttgagacaacgtttcactctgttgcccaggctggagtgctatggcacaatctcagctaactgcagcctccacctcccaggttcaagcagttctcctgcctcagcctcccaagtagctgggattacaggtgcccgccaccatgcccgactaattgtttgtatttttagtagagacagggttttaccatgttggccaggctggtctcaaactcctgccctctagtgatttgcccgcctcggcctcccaaagtgctgggattacaggggtgagccactgtgcctgtccagcagaactttttaaaacttggctttgttgcccaatagggagaggttttatttttctt

SEQ ID NO: 14847 - DNA, 1172 bp, Homo sapiens
tgagccaccgcacctggccttagtttttataataaaaccctttcttggtatttacctttgtaaacatttctcaaattgtgcactaggatttgtgagatcttcacttccagatattctgatcttactttgggattgggactccgcattagtatttaaatctccttaggtgatttctaatgtgcatctgggttgaaactacctaaatagaaagtgggacaagctgctatttgtagggcagtggtcctcaaacttcaatgtagtcagaaacccctggcagccttgttatatataacgcagaatgctgcaccccacagtctctgctttagtgtatttgaagcacaacccaggaatttgcatgtctaacaaattgccaaatggtgatggtgctggtccagggatcacactttgagaaccaaagttctttgggatcttttctctgagaggttcagtctttacaaatagaaactccaacttattagagagaatagtcaaattttaatccacagcagaggtctcaggaagtctgatgtgtagcttcttttggaattctaggaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggtaagaatcatttcaggattctgcagctgacatctgaatttcagggcttttgttttttacaaacagcttcctcagattataattttaaacatttctatatgtaccgttctctggaattaagttcatttacatttttgtgcaaccatcaccaccatccgtctccagaactcttttcatcttcccctgctaaaactctatacctactaaacactaagtccccattcttctttttcttcacagcccctggcaactaccattctactttctgtctctgaatttgactactatatgtacttcatataaatggacaatatttgtccttttctgaccacctcatttcattcattcattgattcatttttaatgtttagggacagagcattgctctgttgcccaggctgcactacagtggcaccatcacagttcactgcagcctcaaactgggctcaagcaatcctgctgcctcagcctcctgagt

SEQ ID NO: 14848 - DNA, 1055 bp, Homo sapiens
ctacagatttctagtgttattctgtactgagatgcctctccagagtgctgccaggtaacatgtgttcacctgagaacagacaaacaggttttcctcatacttgtattcccagggcctgacacattgataagttgttttttgtttgttttggtaatgaattaacatattttgaatctgaatggttaataaacaaatgaaaaacaacttgaggtaattaacacctctggaggaagagttatcttaaatattacttgttaagccatttaagttttctctgttaaattgtattacctgattattaatgttataagattagaattaattaaaatataggattagagctaaattctttttaaaattaatctgttctcttgggagttggtatcctttgtaattaatacagaaataatgtaattaaaaccatagatattaatattttcacggtctcttatgcaggcactgaacttaccttcaactacaacctagaatgtcttgggaatggaaagactgtttgcaaatgtggagccccgaactgcagtggcttcttgggtgtaaggccaaaggtaccacccttctagacttctgctttgggattagtggtgcggtcctccctccctaacagtgttagggcagtctacattttaagaagaaatctctttgaaattaatgacattcagccaggcatggtggctcatgcctgtaatcccagcactttgggaggctgaggtgggcggatcacctgaggtcaggagttcgagaccagcctggccaacatgatgaaaccccatctctaataagaatagaaaaattagctgggccgtggtggcatgtgcttgtagtcccagctactcaggaggctgaggcaggagaatcccttgaacccaggaggcagagattgcagtgagctgagatcacaccactgcactctagcctgggcaacacagcaagactccttctcaaaaaaaaaaagaaaaattcaatgacattgaataggtgttgatagggccacttgcaattcactaagcattcggctgatcaattatataagaggtttt

SEQ ID NO: 14849 - DNA, 2050 bp, Homo sapiens
tgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccc

SEQ ID NO: 14850 - DNA, 1128 bp, Homo sapiens
tccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcatatatggcccttgccctgtgttttgttttattggctgtggggagttgtagtctaacaggagggaggattgtttggggtgagagcagaagccagccccagagatagtacgaggtggggggcggggggcgcagggatactgtgaagctaagcccttcctccaagcacgtcatgggaatagtgtgtttcctctcagcagccacagggctgcccaagcctctttctccctctgttgggagtggctggtttcagtttcagtctccctccacaggaagcccccatcactcatgaaggaag

SEQ ID NO: 14851 - DNA, 1217 bp, Homo sapiens
gaggctttagtcacttctctttacagatatcaaagctcagctctttgaaacatccagcaagacaggccagagtgtgggtgagtgctgtgctggagcctcacagcaggaacatgcaggggcaccagaggaagctgaatagggcacagagggctgggtcactgggagatcccagggctactggcattgggccctcgctgatcatcatttttcctgccagacgagctcttccagaaagtggcagaggattacgtcagtgtggctgccttccaggtgatgacaggtgtgtgcttccccagcctttatggagacttactctaggcccacagcatctagcccctttcctgagttacctgatcccaacagaatggtgctgagctgccacctctctttttgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgcatcacacccagcccctttccctgctgtgtggattaggtgtcaagacacctagttcttcctggggccacccggctggcctcactgcttatattaaggctcctcccaactctcattttcctttggaaaacaagacttttttccccatggttaccgctgagatactggggctgtagtagtataaaagctcacagttccttctgagtgctgaaaagagtgcatgagttgcttcgaaataaaagggtcaagcattcctacctgagacaggttggtctgactagctctactgcatctgtcatgtttgggcccctatgtcagacctgtgactcaggtcctgagcttcccagtgacatcctacaatgtggtttaatggtaggaaagtcctaagttctgtaagccagaaaggtctaatggatccagatttggttccaattcagctgctaatttagaaaagggacttaaatcctcatct

SEQ ID NO: 14852 - DNA, 1230 bp, Homo sapiens
ttgcccctaagagactgcccgaggggattcccatttggaggctccgggcctagagaggccacgccttcccgtaaccttgcagggtggtatgtgctatggttcaaaccagagttaagggcccatcccagggcaaattcccactcccgccatctgactgacctggattcctgccttctagcaggaatggacctcatgatttattgcaccccaggaaagcgccacgggcagagaaataggatttccaactccaagatccctcccaactcccatactgccgcctcttcttgtctcaccacactgagaaaagaatcttacactaaggtctcaagtaaaccaccacccaggcccaacctcccttcaggaccttgcaggcctggcctggccgcttccccgataaggtctacctaggattcgatatcgagtccttcctggtcccagtacttgggggttacccataattcgatctccagatagcgagatggcgcggttttgctcttccaaataccacgtacctatagggattcgggtaccgctgccagaaggcggcgaacacttggtcccaggaactccggagcacgctctggcccaggaaatacttcaccatcgtcccggccgaagcgggctcagcacccgcgcagcatcaggggtgcggagcctgggaggcacgcgagggccgggccgggccggggctcggcgcacacccgccgccaggctcgtagctcagtcaccaccgcaccgcgcccaagcagctgccgccgccgccgccgccgccatgagttgtccggccgcgcgccacttccggcgcagccacacagtagccaccgcttccggcgcccgcgccacgtgaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctggg

SEQ ID NO: 14853 - DNA, 1189 bp, Homo sapiens
aaaccgcgccatctcgctatctggagatcgaattatgggtaacccccaagtactgggaccaggaaggactcgatatcgaatcctaggtagaccttatcggggaagcggccaggccaggcctgcaaggtcctgaagggaggttgggcctgggtggtggtttacttgagaccttagtgtaagattcttttctcagtgtggtgagacaagaagaggcggcagtatgggagttgggagggatcttggagttggaaatcctatttctctgcccgtggcgctttcctggggtgcaataaatcatgaggtccattcctgctagaaggcaggaatccaggtcagtcagatggcgggagtgggaatttgccctgggatgggcccttaactctggtttgaaccatagcacataccaccctgcaaggttacgggaaggcgtggcctctctaggcccggagcctccaaatgggaatcccctcgggcagtctcttaggggcaagcttctgagggtcaccttcaccctgacacctgcagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtgagacacctcctgttgtgattctgcacctccccctctcccctccccccgagatagagagctcctcagatacatgtggctagagagccataaggcagcttttgtggccggaggcaggtctgggttactgagggttgacagctgtagagtatgacctcaggttttcttcttttcagctggccatcctctctggacctgtcctttgactcattcatacagtgggggaggggtacctatcttacggagttgtcctaagttctaaatgcaaagcgctcccatctggcatctatggcacagatatatgttggactcacaggagtgatgctgagtggcggaggcagtgcttttcttttttttttttctgttttttgtttttttctggtgacaagagtctcacccaggttggagtgtagtgacatgatctcacctcactgccac

SEQ ID NO: 14854 - DNA, 1776 bp, Homo sapiens
gtggcagcaggtgttaaaggtcccacgctgtggcagcaggtgttaaaggtcccacgctgtggcagcaggtgttaaaggtcccatgctgtggcagcaggggttaaagtgatcgtgccggtctctacttggctgtcacggtgggcacccctttccattggaacatagccttgttgtacctaagaaaagttgattgtttcaaaattcatacctagaggtgcttccctagaacgatcgatgtgtattctgacatccgcatttcacacacgcaggaccgtgatgccatagtctatgtttttgccatgtgtgtctaaaaatttgaggtatttcatcatacaaaagttaaacgtgaatgtgtggctatggacctgccgtgcgacgtgagaaatatcacggacgcacttggatccctctgtctcctcctgccaaaggtgattgctgcaggatctgactttttgtgtctgtctgaaaatttttaccacagggatatgtatctctacatacattgtattgttttgaatttctgaagactaagtggtacatggacgtattcctcaacttttgcaattcagcatggttggtgagtctttggattacatgtggctcaagatgggtgtttctcactgtgaggtatgaacagactccagtttctccattctgctgctgattggaggtggtttagggcttttgctctgctacatgatactgctctaagcactcctggatgtgtcttatttatttatttatttatttatttatttttgagacagagtcttaaactctgttgcccaggctggagtgcagtggcacagtcttggctcactgcaacctctgcttcctgggttcaagcgattctcctgcctcagcctcccgagtagctgggactacaggtgtgcaccaccatgcctggctaatttttgtatttttagtagagaaagggtttcatcacgttggccaggctggtctcgaactcctgacctcaagtgatccacccgtctcagcttcccaaactgctgggattacaggcgtgagccaccgcacccagcccattttcagttttactagagggtgcctcgctgctctccaaatcgggccgtgaccacagtggggtggcacctgccgagatcccctctgtccctcagcacctgatatagtcagagctttccatttttgacaggtggatgcaaaagctttcgtttgtttctctgctagccatgttgggatgtgtgtgcgtttattggcatctgtgtttctgtgtggtggtttagtccgggccctttcttccggccgtgtaggagtgcctgtgcggggctcctctggtgatatgcccttggcgcataccttccagtgtgcctgggggcttttgcttttcaatgacgtcatttgatatacagcctataatttagtgtgatttcataatctattctaaagattttgtttttgcttaaaagctttaaaattttgcttttcaaatttggcatttaatcgaagtggagttaagctggcgtagggtgtgatgtagggaatccatttttccaattgtctccagccagttccagcaccatttaccgacccctgggtccttctgcaccctctgaggcgcacactcaggtggccacgccacatctgctcctaaccctgcccctcagcttcctcccctctcgggctggaaggctatatacttggctgagctcccggctccttccagctagggcggccgtgtgcccactgcggctggtcagatgcccgagcctgccgacgagggcctccagttcctct

SEQ ID NO: 14855 - DNA, 1092 bp, Homo sapiens
gagtgcctggcacatggggctgggtaagagagaaccctggctctgattgttgccgacttcctgtgaacctcacaacagcctagtcaggggacggatgagtagtcccatttgatagagaggaaaggcagagtcagtcaccaaggggtggagactccttggtctccactggggaggcccctccggggtggagctgtcttccactcatctagagagtcctgggagtcctggctctagatccttcctctgctcccttgagtccgggctgttgccagggagagcagggctgtctgtcgccctggcagcaaatgagtctcgcaccttgctccacacctggcccccggaggcgagtgagctgggggggctggccccttctgactccctggcaaactgagcagcatctgaccctgctcttctctctgcacagggacctgaagcccgagaacatcttgctggatgaccacggtgtgtaagggtgcctggggtgggtcagggtggggtgagatgcagaggcctggcctgttaacgggtccacctgtttctccacccacactcaggccacatccgcatctctgacctgggactagctgtgcatgtgcccgagggccagaccatcaaagggcgtgtgggcaccgtgggttacatgggtgagtcttctctgcccggcccactagcctcctgggttccctcactatccacccacccagccacacccacttctgtctgggagtcttctctcaaaaggggcctcagtagaaagggcccatgccgatgctcctcttctagaggttaggagaccaagactcagccggggccgcacacagttgtgaagccatgtcgttcatttgctgaatacttattaaaccctgctatggctgagcctgcaggtggctaccgggggatggaggagagagacccaaacctgtttccgtggccccagtccctgccctccctgtgcccatctgtgagggaggccagtggaggggccaacatgaggccccacattccacctggagaccgagagacgcaggaggcagagtcctggctctgcaggctccgcctcttgccggttgcgtggccttgaaccagacactc

SEQ ID NO: 14856 - DNA, 1152 bp, Homo sapiens
aagccagatggtttcacatacaaaatacagatttctgacttcttgtgtaaaatctgaagacccggggaccctgggcgcggcctcctgcagggccgtattcaccccgcttgatggggcctgtgctctcctactggccaaggtcccccctggccagcgggtgtgagtgtatcccagacctaacgtgcactggcgttcctggggcctgagggtccactgcccgcctcctgcccagccctaactcccatgccgcccgcccagctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacaggtacggcagctcacagaagcctggccagccagggctggggtggatgcacctttccctccctcccacccactcacctgcctggcctgcctggccgactcacccctgccacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacgtgagtgcagcccactcctgctgagggcggggcccagccagggctggggctcaggggctcttgtagtatcagccaggatgcttccagtgcaagtggcagaaaaaacaatctagtggcttagccacagaaataaagataattcacaaaaaggaaaagccccaggatgggtctggcttgtggcatgcctggatggggcttggagcctctgacaatgtcctaggaactctctctccttcccctcactgtaccgttgagtgtgtagtcttcatattggggtagctctccccatggtgcggcagcagtgggccccagcagctcagccaccacagtagacagagagcttctcttctcttttctcttctcctctcctctccttccttccttcgttcttttttcccttcttttttcctttctttcctttcttccttttcttttc

SEQ ID NO: 14857 - DNA, 1606 bp, Homo sapiens
caccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaagctgccacatgtctctgtgtgaatagtccgagcacaaacctggctagccgcccctgcctgcctctttcttgcttccggtgctccaggggtcttcctgctcccctggcccagctggaagcgggaagggattggaggtgggcctggagggaagcagggtgtgcccttccgaggcccaggagcccccagggctgactctgaactagcctctccagacagccaggctttggtagcctttgggctcacccagtgggtttcccaacttcctaaatgggatggggcctaaggaaagaagccttgggtacccactgggatgtgggtctgtttctgactgctggtaaggcgggccccgttggtgtcctcccctccaaggctaaggtggcctggctgcctaaatgtggacgtaagagtagggtgggagctgtgtaaggaatgtctgccccaggcctgcgttacctggacgccagccatgtacgggccccgggctgaggcacgtgcatcatatccacccctctgttttgcccttgacacattatgggcaaagacctagacagtgggtgacgctggc

SEQ ID NO: 14858 - DNA, 1199 bp, Homo sapiens
tgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttttttttggaaagcacaaacttctgtaacgggtcgtgctcatgtctgttaataaagaaatccagatcccttcgggctgccgcctgccctgacccaggttcccaactcctcccacctccgaggccgcagcacctccttgccaccagggggcgtcctcaccctaattccaaggcccgccaggcgggggcggggtgggggggcggtg

SEQ ID NO: 14859 - DNA, 1169 bp, Homo sapiens
ctggggagggagagggacatggagtgggtaggacaggaacggggagggctcctgctgtagccatgacaacagggccaggcatcggttcaggcgggagcccagcagggtactgctggaggcctgggtcaggggggcgcaggcagtgaggggagaaattgctggctggtcgagctcagtgcgcagcatcccggccctggccctggcagcctacaacccagtggagcgggtgtgtgatggagattccaaggcgacggttccttggttaccgttccctggctaccaggatcctcatcccccattggctagtgccaggaacttacctggcacgtgccttggtccccgctgcccctcccccggggagggaggaggagaagagagaacctggtgctcccaacagctctgggcatcccccagtaaccatggcaaccctgcaattggcacacgactggcccaccccaactgcattctccttgaacacaaaggaccctggggacccgccctcagcctcaatctccgcctctctgaaatggggatgaggtcactgcagtcactctcgcccagactctggccccggggtggccaagcctgagctccaggccttccagcccctaggctgcctcagtcctggctgaggcttcctgagactgctggcctttccttctgtctgagctctaacagaaagctgacctggtggccttcctccttcctcctcctccctagctttgtgtgccctggctccttttgataggctgcggtgacagagcaaccattgcacagaagggaaggcagagatgcctcctccatcaccccatgcaggcccaggctgaggaccctctgggagggaggagagccggggcctaggaggaagggccttgtccctgaagtttgaaagggctctcaaccccttctccaaactcctattccccaggtgccaaggcaggaggctggggctgtgaggaggggaggcagaaagggagggcaagggagaagagaaagaggaggggagaagcagagggagaaaccaggagaggaggaagaagagaaaggacagaagtgaagggacaaaggaaatgaaggcgggagggatggaggggacgtctcaggaggttgtggccagggccaaatggcctcagcccctccccttcctggattcccggcttcctacctcc

SEQ ID NO: 14860 - DNA, 1182 bp, Homo sapiens
agaccagtccaccgctctccaccctactgccactaccttaaaagccatcagtggctggacattgccctcgggcacaaacactgtagggcctgcagggcccttcacgatcagcccctgccagctttatctctcagcctctcctttctgaccttcctgcccacctgccccacccaacccccacatcccccaaaaaatctgggctacagctatacctctgaatgatttgcattcccagaagatactgagctttcccatttccagcctttccacttgctattccttctctctagaaaatgcttgtctcactgcctccgggatgattccactccccattctgtgctcagtgcagatcctcccacctccaggaagcactccctggtgaaccagtctgtgttgggagcatctcctctagattcccagatcaccccgtgctttcttccatgcagcacttgtcactgtcactctgaattcaacaggctgtttgctgttgtctccctcagcagactgaagtcagcgaggcagagaatgtctcacgtacgctaaactcacagggcctggcctgctgcctcacagcctcaatggtcggtaaatggttgtcagatggaattgagaaacataggaacttctgaagatcaggcctgggtgtattgtcctggctctgccacttcctagccacctcctcctcctgttctttccaaagtcgaggtttctcacctataagcagagggtcatgatgcagcaaagacagtggcgaggattaaaggagacatctatgggaagtgctgacggtacagagcagaaagtgtgtgtttctgtgctttctcctctggcttccagagtgtatatggttccatatcattccctccacaccagcagttgtcaaacttttttttttttagcagccaaacttttctgtgaaatctgtgtggtgctgggggagcgaggtgaagggcccttggtcctcgttggtccaacccagggcctctgagccctactcacagctagaaatgctgctgcagctgctgcagaccaagctgctccctgagggccacgaagcccagccccaccttcgcacatgggaaaggaccccacacagactctcagctgtcctcatactgaccctggaatgtagagatgcctcttcttcctaatttacaaataggaaaagtaaggttcagagag

SEQ ID NO: 14861 - DNA, 1249 bp, Homo sapiens
tcttttttgataatacatttgtgcattatttggtcgttctctttaaattcatttttaaaggtagaagcaaatcaagactggtagatgctgtgccaaggaaagtcagggatcctaggttcgaatcctgtctctgttcgcaattcgctccgcaacctcaaacaaacgacctcagtttcatctatgaaaagctggtaaccatcgtcagttgccaggccatgaagagagtcaacggaaataagtttttattctagggcacccgctctctctcaggtaaaagccgcgccccaatcaggtactgccgcgccagggccgcgggacatctcgggatttgtggtccacccggcggaactcgcggtcccggcaggcaccgcggcggcggcagggcgacgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggtgcgggggcggggaggaaggggcgagtttggaacgtgaccgtggtcttggggcgggggatgcgagacagtcagctctctagagccgggaggagacggcctcgccgtgcccaggcggtcgcggaacccatgccacctcgcgctcctctgacctgggctcgccctgcttccctcaaggaaactaccggacgcagctgtatgacaagcagcgggaggagtaccagccggccaccccggggcttggcatgtttgtggaggtgaaggacccagaggacaaggtgagccaaccgcccccctcctctccgccagcctctcagctaggcgggctccggtacttcctcttctagttcctgcatctgctaaagtgggagagacagttgatgttgtgggaatatcctgctgacttgcagaccccgcccggtctgtgaaatgggcggattaattgtggtgataaaaatcaaagagttttgtcaactcttaaagtcatctagactttaagatttcacagaacatgatactttccccacaaaatgagcagcttttaatcttcccaagtaaggatattaaaacgaacggcaaaacccttcagctctcaccttctgtcacttttcgttaaaaaactcatggcggggtgtgg

SEQ ID NO: 14862 - DNA, 1072 bp, Homo sapiens
ggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaagggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgcaagtgactcagtcatcagtgggcacacactgcagggtgcctcagggaatgccagttcttccaaagagcaaagcacttcacattccaaagtgaattcccaccagtcagcttcattctttccttcttctccaggccttcctgtggcagggaatagtgggtttgtccaagattatacaacaagtaaattgggctggggctcaaatttacaccctttcctctgtgccagctccctggtgaagttccctctttctagagtcagtaagcaggattgtcatggatgctgccaggaagtgcctggtaaggaggtgcattgagcaggggagtgctacaggacagccaccctgggctggcagggacaaggatgttgatgggctaaaccaacagcaagtgatttcaacc

SEQ ID NO: 14863 - DNA, 1164 bp, Homo sapiens
ggaacagggtgccagggccaggggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaacattatttttgaatggtgaaaacagtgacattaagatttgtgctctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaagaaaaagtgccttgaatggcttctaaacaatttgatgactcaccagaatgttaaactttttaaagaactcggtataaatgtcatgaaacagctcattggttcctctaacttatttgtgatgcaagtggagatggatgtatacaccactctaaaaaagtggatgttccttcaacttgtgccttcttggaatggatctttaaaacagcttttgacagaaacagatgtctggttttctaaacagagaaaagattttgaaggtatggcctttcttgaaactgaaccaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagaccgtgaggtagggcctcaagaaatcaataaagaagacctagagggaaatagcatgaggtgtggtagaaagcttgccaaagatggtgaata

SEQ ID NO: 14864 - DNA, 1243 bp, Homo sapiens
actcgcccaacctcggaagcccgggttctgccacttccagccacgcgtccttgggctgcgaaactttctccagcccagtttcctcttttgggacatggggaggcggaggctgccaatgctgggatggagtcctcgagagcaagagaccagcggcctcgacgagcttacaatccgattaggccctcccaccgatgtgctgtagctgcccgccgccctggacccggcgccgtcccgcccggcttcgggagccctccgtagcggccggactcgcgcgcgttctaaaatgaggacaaagcccgcccaggtctagagcgcgcgcgccgtggcggccaatgggacgctgaagctaggttgagtgacggacttgagcagccaatgagtgtgcagtttgttgcgatgtggcacccggctccggcattataaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcggggtaggtgcggccgcgggcggacgggggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccgg

SEQ ID NO: 14865 - DNA, 1196 bp, Homo sapiens
acagtgtaggagccactggcagcaggggctttggagtcagacaggcctggctcagccatgggagctacttgattttgagccttagacttcggggtcttaataacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggatatgctgtgtgagacctcttgctcagggtcgagggaggcggggggggggtgccaggtgccctggacttggggctttctcctgcagcaggctcttccagctgcaggcccagttgtgggggtatcctttaaggactgccctgcctagggctgagccccccttcaaagaaaggaatgagaggcctatggggagtgaggatggggcagtgatgagggcttacatccccagcaggcatgtcccctcctgggacaccttggaacaccaaccttcttggctgatgaatgaaaaaatgggattctttacacactagggcagtgccagggccgtctgaattggggcacaatag

SEQ ID NO: 14866 - DNA, 1142 bp, Homo sapiens
gtagaaaacgcaagtattttcaccataaccagctagattgggatgaacacagttctgctggtagatatgttaggagacgctgcaaaccgttgaaggtaaaagaaaaaagattaaaggttaaataaaccacgtgtttgcactattaataattttttttaaaacaaaaacatttctcccccaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactactttatattcttaaaggaatattctttatatacttcaaatttagaacttaactttaaaagtttttcttctgtaattgttgaacgggtgattattattaactctagataagcaggtactagaaaccaaaactcagaaaatgtttactgttagaattctattaaattttaagtgttgtattctttttcattgggtgatgtcagggtgataaccagacattcatggaaaggcatgcagtttgtccattgtgacagtttgtttaataaaaccacatacacactttatttaagattaaaatctaactggaaagtcagcttggaaaatggacatttccaagtatgtttggtgagtcacagatataaaaatagaaattctgatgagaggtttcagtttttaataccaagtccttaggagtcttaacattggccagcatctgtttatcaaatgacataaatacgtaaacctataagaattaagttt

SEQ ID NO: 14867 - DNA, 1216 bp, Homo sapiens
gactcacaactatattcttttttcttatgagtccctaattatgcctgcttttgttataattgtacttaaatccttaaagctagctgaggtccagatagtgtaattgcttttggaggcttcacatataaggttgccttcttattacacatattttaggaattaattattttatggaaagttatatatgaagagtttattattaagcattcctttcatcagtttaaatgtttaattcctcccaggcgtttttcctccaattttatatttgatttttcattcaattcacagttggtatcattaaaaaaaattctaatacaattagctagaccttctgagaaaaatgttagaattaaactcaagcagtcagtatagtatatttcttaaccgactggttttagcttatcagaaagtaattattttatgtatttaaatacatttacaaagaaaatgaggcttttaaacagacctcactatttaacattgtacccagtagtggtgagcatgcttagtacccaaattttggtttctaaatgccattccccactaaaaggaaccagggttccttggagaaatggctgattccatgtttggagcaggggaagtgggtggtgtggctaaaatactttttattaagaaaataaaataaaaagcaagatagtatttgaagactaatggggtaatgtcagaagggaacaggcgccaagttgaaggtattctcactggccaaatttaggacaacttagaataatcactcttactggtgataatactaagaaggaaaagaagttcataatgatgaaagtagagaaaaaagaaaactctatacaattatttgaagaatgtcttcttttaaatgtacatggaatgatagatttggaaaaattaccattttacaacccttaatgtaattaaatctggcaaaaatcgatggtaaaacccattaagtggaaaaaattttaaggaactttgtttacaaggtgtcagaacatcacagatatctattgcaaaagaattgcctttacagtgagatttggctatcaaactgcatttcactacttctggaataagccagcattatgtggctcttgatgggatgcggtatgaagcatgtgtgatcatccttgatgtactgccgaaaatgtttacctcaaatttaattaaatcttttgtctagacttatcttcctgtttaaagaaatacaggaatagaggaacaa

SEQ ID NO: 14868 - DNA, 1200 bp, Homo sapiens
cgccttggccttccaaagtgctgggattacaggcatgagccaccacacccagcctatgaacttaacttttcaaatatctattgacttattctcattcttcttttttttgtttttttttggtggggggatggagtcttgccctgtcgcccaggctggagtgcaatggcacgatcttggctcactgcaagctctgcctcccgggttcacgccattctcctgcctcagcctcccaagtagctgggactacaggcgcccaccaccacgcccagctaattgtttgtgtttttagtagagacggggtttcaccatgttagccaggatggtctcgatcgcctgacctcgtgatccgcccgcctcggcctcccaaagtgctgggattacaggcgtgagccaatgcgcccagccaagttttaacctttttctaccatgcttaaaaaataaaaattaccttacattttttaaaattgtggtatattttgaaatacttcataattagcttgctttccataagcaaacaattcctcttggtgtccttgtttgatacagataacaaaacaggataccaaagttgagctggagacttacaagcaaactcggcaaggtctggatgaaatgtacagtgatgtgtggaagcagctaaaagaggagaagaaagtccggttggtgagtgtgcaagaccgagtgtctttagaaagagtttccccgtagtgttaattctgtcaacacttttcatagacatgcttcaccatcctgatggtcatagaaagtcagaagctgttcattaaaaaaattttttttaagtctatggttacaactcagttgtgcattgtcactcatattttttcccattttataaatattttttgtttgtttgggttttttttcaagacggagtctcactctgttgtccaggctggagtgcgatggcgcgatcttggcccactgcaaactctgcctcctgggttcaagcagttctctgcctcagcctcccgagtagctgggattgcaggcacccgccaccacacccggctaattttttggtttttggttttttttttgagacggagtttcactcttgtcgcccaggctagagtgcagtggtgtgatctcggctcactgcaacgtctgcctcccaggttcaagcaattctcctgcctcagcctccagagtagctgggactacaggcatacgccaccatgc

SEQ ID NO: 14869 - DNA, 1316 bp, Homo sapiens
catgttgatcctgaagaatccgttaaaatggtagcacaagagtctggcaagttggtactgcagagaaaaggggttaattgaggcttgtttggagtcgggattcccctttcccaaacatgcgtctcgccacttggacagcagccatttgtactcgtatactttttaaactttttcttggaatactatattttatttgactggtagtctgatattactcctaacttgtcaaattgatctctttgcaggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcactctgtcttgtctgtgcttcagtgtcatgtggactgagtcttggtgctctgtgcccacctggggcctagggccacatctctggcttggcagttgaggctgttgcgtagatgtcttcagtcttccctccagtgcaactgaaggtaaactcgtctttggggccctggtggaagggctgtatgtcatttggctgcacaggacctgatctgaactgcctgtaactcattaagcacttgcacaaaacaaagggggaggcgccagtgccctcactgcatgcctgcatgtctttga

SEQ ID NO: 14870 - DNA, 1471 bp, Homo sapiens
gggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacgggtgagggctactgggggttgggttggaacgccccgaaggcaccacagcaaccgacgcgggaacgcctgttaaaccagccccgccccgagacgcgcgcgcccggcggtctcgatccagcgtggcccgcccctcacctcccgcccaaccaacagccacttcctgcctcactcccggccaatcttcacactccacgaagaatagccgtagggggcgtatgggacggtgcgtagagcgatgcccacgccggccaaccggatgtcggggcttgcgcgggagggcgggacttggcgccggctgtggctactcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagaggtgagaggggagacctgagcgcgtcctcgggcctgtgaggacctcggggggctgggagcgcctctgcggctgaggggtcgggcgtggccggcgactgaggggtcgggctggctcttgagggcccaggccctggccgacgcgcccgccgtgagcgaggaggcccgaatccgggcgtctttggttgggttgcgggcccaggccgcgccgccggggtcgggaggcgtggcaggtggcccgacagccttctttgacctctgggaaagctgacttattcctatggctttgcttctagggctttcttaggcctctttgccggctgcctgggcagccgcgaggtgggctggagtaactgggtaaaagtatagggtggaatcgggcctactaggtacccctagtagtagggaagggtggtattagaccgagagggaatgtttacaactagcgttacagtttaatatttgaaaatccaaagcggagactggaccctagttccctgaagagaaaggggaatgtaccagaaggagaacacgcagtggttgagaaacttagcagttacagcacctattctggaggcgagtaatccagttggagagggacagggcgttaaaagcaggaaagcccccgaaagctcatctaagtgcatctctttccacaccggaggcctggaggtatgaaatgactggcccaaggtcatgcgattagtgtactgatggtgctgggattatagttcagggatagaccgtgcagtggttaacgctaaggccctggctcgagtctttgattggtcattggttgctctgtgaacttcggcagtttt

SEQ ID NO: 14871 - DNA, 1220 bp, Homo sapiens
gtcacttttgctttcagagtcactgctgctgtaataatccttgtacatgtctgggtgtatgttgtgagtatttctctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaa

SEQ ID NO: 14872 - DNA, 1085 bp, Homo sapiens
ccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttcactgcag

SEQ ID NO: 14873 - DNA, 2633 bp, Homo sapiens
aatggggctagtgtgccataggccagtagattgtttgggattaagcaagattaagaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttacta

SEQ ID NO: 14874 - DNA, 1931 bp, Homo sapiens
ccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacaactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagtatggaaacaacctttgtatttgacgtcacctggggtctgctggcagaagtttggggattggttttcttttgtaatttagctgcttgcttttcttggttttttaattttttctttttaaagaaatgcttgtcgagtcatagatttagctgctttcttattgcacattgttgggtgggagctggtttggttgaagcctcagaggagcttctgttatctgctgatagatactaaattagagctagcatcaccctgagaaagcaggct

SEQ ID NO: 14875 - DNA, 1295 bp, Homo sapiens
cgtcgcccgcccccagcttcggtcccgctccccaggagccccgcccgcccgcgatctttccccggccccgccccgctccccgcccggccctcacctgagctgcgcggagcgcgcgtagccctggaagtagcggaggcgcgcgaacaggtagaccaggccgcacagggccgccgcccctgcgagaggtacgcacgggcctggtgagcgccctgcgcgggtcccgggggtccagcgcgtgcgcccctgccccacaccccgaccttcatgaaagaagatgccggcgacccagagcgtggcgaggaacagcgggaagtactcgctgcagttcaccctgcggtgggcgggtgggatgagcgcgccggccgggatggtcctgcgacccggacccgcctggggctcgctccccgccccgcgccctcccgccgcgcctcactgggctcggtagacgcgctcgaactcgggtgggccggtggtgagcggcggcgacacgcggaaggccctgcgcgccgagatcacctgcagggagaagtaggctgggggaggagggggagcgggagtcaggtctggacacccgaagccccagagatgggagtgggagggatcctgcaatctggcccttcacttggccgtgtcctctcctccctaaggcggaaccccgccccctccccgcccgaggagacctctcgtctcacccatccctggcctgccctgtgtccctgacattcagcgaggagggcagggctgaagcctggggcgcagagaggccctgtcccaacctgtgagtgtatgggggagggtgagtgattcaggcacagggacacctgctccgcgagagagaccacttgagtccttgtttctgaatcatttcactctcaaaacacaggcaaatgcagctttcaggtccctggccaggaagtgcctcgggagtctgagggcagagctggctgcatcctcccaggtgcaaggaagcacactccctgtagctaacagtccctggtcacccacctaccagcgcccaccagcagggccctctgaccctgcctcaggccgggatcactaaagcctgcgtccctgtgcctccaaacctcagtttctctgttcctgcattccggtcccaggcctaaatctgacagacaccttctctcctgctcccaggaggttgcagctgggactctcctagcctaaccccaggaccccagggctggggtagttgcagagggtgggctggccctaaagtttctctgtgggcaggagcccttctcttggtcaggtgaggccaggccagaccacacaca

SEQ ID NO: 14876 - DNA, 1127 bp, Homo sapiens
ctgattctaaggtccccaggagatggatcacctgatgacatgagaatgtcttgtttttggaaagcctggtcatgcaatttagcagaaggtttgcggtgaggtggaaggcatttatttgctttgtcttgctaaccctcaaaatcaaagcctgtcccagcctgacagcttccagcagaaagtgtcagaaccagaggcccagccaaggcccaggcagggcaggcggtcctcctgggccctggcattgttcttacacatggagggcatggccatcttctctttcagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcatttctctctatgcaaacgtcattggttaaagtgctgatgccatttaattagattgtttacaaatttaacaggatggctacaaagagatcttattttaaaagcagctgatggtttggaaatgagagaactacagtggtgaagagaccaggaggcagctctcagtgaaaccaacattgcggatgcccttcgtgagccttctcagtcccagcaggaagcccacaacactggcctcccc

SEQ ID NO: 14877 - DNA, 1305 bp, Homo sapiens
taggctaagagtaacagcgggaataaatctatatttctgatagtcttcatgatattttctagttttttgactttcttttccaaatctgattggtggtgatggtttgtttgtttttttgtttttgtttttgtttttttttaagacccagtttcgctctgtcgcccaggccagagtacggtgacaccatctcagctcactgcaacctctgcctcccgggttcaagcaattctcctgcctcagcctcccgagtagctgggattaaaggtgcccaccaccatgcctggctaatttttgtatttttagtagagacagggtttcaccctgttggccagggtggtcttgaactcctgacctcagatgatccacccacctcagcctcccaaagtgagaggattacagccatgagccacgcaccagttgtaatggtgatggttgttttttaaccctttatagtagctaaaaagagagaagtatcagctctaccagtttatttttgctggggtttttaaaaaaaggcatttgtccatttgatgagggacaatttagtaaaaagtggatcatttcgtctgtaaatcctgtaactgagtagtgtatggctattatactgttggcagtattatctgaaaacaaacggatgaatgagagagtcactaccatccctgttgcatttcagaaatccctctctttatttaggacaactggtataccacatgagacagacagacacacagacacatacgcgtgcgcgcgcgcacacacacacacacacgcacacacacacaaagtcatctgacattcaggttgaggaaagcagccagtgttaatccttaattaaatgccagtaaaacttaacttacttctagctgggcatggtggctcagagtgactccttctcaaagaaaaaaaaaattgcattttttgtttgtttgctgtttttttttgttttttttttttttttttttttttttttttttgagacagaacctcactctgttgcccaggctggagtatagtggctcgatctcagggcctggctaatttttgtatttttagtagagatgggttttcaccatgttggcctcaaattcctggcctcatgagatctgcccgccttggccacccaaagtgctgggattacaggtgtgagccaccactcctggccaaaatttatttcttgttaccaataaccagcagagtaattttttaaaaactcaaatacatttaggaacacccatagataaaagatcaataaaacaaaaattaagtcagttgtagttctatatgccagtaacaaacaattagaaa

SEQ ID NO: 14878 - DNA, 3329 bp, Homo sapiens
cttttgtgatactgcattttcagataaatatagctgtgtccttttgatgtctgcttgaaagcagcaggtattttttaagtagctaacatgattatacatggccacatatatgtttagctactgagaaaaaaagaagaatcttgcaaggaaagacataggaatatgggactcttggcccaaagaaagactcaaggaaaagttcagaaagtccagctgactgacttcttgtctatactcatagttaggattgggaaactgcaaaaggacagagccgagaaatggcctgcagtctcgctgcctggatttgcagcaatgtcgtgcctcagattttattatatttggttttcttagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaatgtatagcatgtccaatttttgtgtgtttttacatggcaa

SEQ ID NO: 14879 - DNA, 1856 bp, Homo sapiens
ccaaagtgctgggattacaggtgtgagccaccgcacccggcccagtagaagcgtacttatgaaccattcctacctttccttcccactccaccctaaacaaataagtcccatggaattcatatatattcttgcaagaaaagttaatttttaacagtacacaccaagttacctgtgtttaaaagcatgaaccttattctttaaatcatgttaacagatcatgacacacatcaggtgcacagtaaatgtttattgagggactaaaccttatacggttaaatgaggcttctggactaaggaatctgcctccaagacgcaggtctctaggttggtgaccatggtgaacatctgtctcttgtttttaagtactctgaaaattgtctgtgagaggtagcatgttgctgagatctttggggtcctgaacagtcactttctttcattttaggttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtgtgtttgcattttgttaacctcattctttttgtgtactttgaattttgaggactgtgcaggagctcggcagtgtttggaggggcagccctgtttgttagtaacattggcctcgtccacacctgagacctatgggtttctagtaggaaaaggagggctgttgtccaggatacaacaaatccaagagatttgggactcagcagaggggccactgaacctggaaggggttgggcagaacctgtagacagcatagaggggtgaaactctcaaatttgtatttttttcccaataaggctattatagtccctggtttcattaatacaatcagatggaaagattgaaagccagagagttctgaagttttgtgaagtcagaacttaggcttcctacgtaagtgctgtcacacacaacctgaatgatgtcttcatgacaacgggtgtgtgtagccctagtatctcataaaccctgtccaggattacctatgggctactcagcaaa

SEQ ID NO: 14880 - DNA, 1152 bp, Homo sapiens
gaaaattactgaacttcaggggagagtgggaatccttggattcatagtcagttgctcagatgtgtgggtggacccctggcttgcaacaggtgcctgaatcgagggcagtcttatggaaagctgtgcccctgccctatgagacctgacctaactccaggtagttcccatcggagctgcttggccgcagaacctggggaaaccctgccccagggatgtccaccaggagtacctcccctgagctccaggctaggatctggtgctgctcacagcagtgtgggtccctgggccccaccaaagagctgtgtgggacagctgcgggctgaccagctcctttccaagtgtgtgcactccccacaggcggcccgggggagggtgtgtggtcacagccactcactggccagaccatccatcactggtactggcagacagtggtgaggtgggcatgcatggggaaaagcaggagagagctggcccagtccagtggagagccctcacctggcgggccgtgacttgctgcagggcgttctggcatttggcgaagcaaggatccttcataatgaccatgatgacgggcatctgcttgtcaatcagtgccaggggcccgtgcttcagctccccagccaggatgccttctgagtgcatgtaggttatctctttaattttctggaaacaggaggtgagatcagagtcacactgggcagatggggctggagcagatcagccagaggggaagaaggggaaccaggggaaggatgactctggaaggcagagagccaagggttgcaaggcagacagatgcctggagtgcttgacagcactgaggacacccagcaagggcctggggagaggcctggctaccatccagagcatgcaccagcccgggacacaacctctgtgtccccacaccagccccgggcactgctgttgtctctctccagtcccacgcacagccaccccttaggacaaacaagtcggagtcagcctagctcaccccctgctcctccctagccagccacgtgtataacgacagcatcgtattcagcttagctacaccttcagttaattatctgattaagcatttgcccattaataacttctaaagagtggttccaagcaaaatcacacaaactggggtgttatttgaattaattt

SEQ ID NO: 14881 - DNA, 1151 bp, Homo sapiens
aacagttggaactggagaaatttaatgtgaagtatagaaaaaatggaaataggacttaacgattgtcttaaatctaagaaagagggtttagatgtaattttgtgaggctcgatttaggacatccaaactaagaccaaaagtttcagggagacagaattttaaaaatcaagctgtcccaaatagggctatttttgtacaagtagtgaatgccctgtgctggaagcatcagcccaggttgagatgtgtatttctcgggtttgttgtagggcacattcagtcatccggtgggaattttaggtgtcttttctattctgggactctgagagattatttgctttcagacgctgtaagaatatatgggctgatgggcgggttttgtctctttctttgtttcgtttttatctaatgtagccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtaagaaaataatgtgattttatgtagaatattttttgacataagatgatttagtaatgttttgtttctgatcattccaaattaagtccaaataaaaattcagtttgtaatggcagctatgagcaggttttaaacatcatgttggggtggaggggccattttgaagatgaaacgatattatggaaacttgaggagaaggatgttaatcatcttgaataaacacataagcaataacgtgaaataactctttaaagaacgtatgtagttccattttattactccaaagtcagagataattatggttattaagacagcctctttgggattccagcgtgtggtaatataatcatagtttaaatttgagttaaaattatagaatctcaattttgcatgtatttataacttgattagaaaaatacacctcaggtggaaaatgagctcctttatttgcacacatatcagtcaagcgattttgacaaagagcaaggatcttgatttttattaaaatg

SEQ ID NO: 14882 - DNA, 2580 bp, Homo sapiens
tgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacgg

SEQ ID NO: 14883 - DNA, 1157 bp, Homo sapiens
cacaccttggcctcccaaagtgctggaattactggcgtgagccactgcgcctggcctactgtattattttaaagcatcagagacaacatatcattgccataaatacctcagtgtgttatctctaaagaaacagactttgtaaaacataaccacaaagcagtcctcacacctggacagattaatgattctttccaatgtctagcattcaaatatccccatctgttgaattggggttcaaaccaggcccacacattgcatttgtttgatttcagtaagtacttgttgagtggtcggggcggggggaagcaaaatctctgggaggcagagcgtgggggttggttgggccttggcgctgggtgctggggggattctagagggaaaggcaggcaggttgcaaagcaaggtcgggcgcggccctgcaaagactgtgccaggggcctggctgcgtggggacatttctccctgtctctgtctgcagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaa

SEQ ID NO: 14884 - DNA, 1258 bp, Homo sapiens
gcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctcttgtgaggtctgttccttcaggtgagggtgtaactcaggatttcttcctttgccgcccctgcagtgagaagccacacaactgaactggttagttgcagttaaaggcatgctttgcacctgttaccaggcaggctcctatttcaacagggatgtggaccctgctccccattttaatatcttaacctaacttactaactgttcagtctacttagagatgtttgccacacgtagttgaaactgaagccagaaatgcctcatcaccattataaattgaggggagtaggaagtggagggtgcatgtgggccttcaatatgctgtagttgcttagcacagaaaattgcaagggtagtggggtctcagccgcatgttgaaccattccatccctgtactgaggtttctat

SEQ ID NO: 14885 - DNA, 1076 bp, Homo sapiens
tagatggtggggacatcatcaacgccctgtgcttcagccctaaccgctactggctgtgtgctgccacaggccccagcatcaagatctgggtgagtgtgggttacaattgactgggtacctggctgcactctgagccctggcaatgttttggttattatatatgccatctgactcccacctgggagctaagctttctcagcctccacgtaatgacattttggtctgagtaactctgttgtggtgtgcagtcctgtacattccaggatgtttagcagcatttccagcttctactagatgtcagtagcaaaccatccttccactagtggcaactgaaaatgcatgtaggcattgatacatggaccccagggagcaaaatcatccctttttaacttgagaatcttgaggggcttttaagaggagactctcttgattggtaagtcttaaggttgcttttgccctgttccccaggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccggcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccact

SEQ ID NO: 14886 - DNA, 1489 bp, Homo sapiens
tttttggagatgaagtttcacttgttcgttgcccaggctggagtgcaatggcacaatcttggctcattgcacccttcgcttcctgggtttaagcagtgttcctgcctgagcctccccagtagctgggattacaggcacccgccgccacacctggttaatttttgtatttttggtagagacagggtttcaccattttggccaggctggtctcaaactcctgacctcaggtgatccacttacctcgccctccctgggattagaggcgtgagcttctgcgtccagccaccatctctaaatttttaaaaaattttcttgtctggaatctaaagggattctattgagcttaacggtttgggttcttggtttttgaaaggtgctgccagccatcatcctactgaggggtagggctgggaggtctagcatttcatgggataggactgtttgccctaatttcctttccatcttctgtaggatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataatctaacgtgaagtggccaggacatgttactgaatgagaaatggctaccgtatccagaagtgccaagcccttttttgttgggcctgaccctagctcatcaagagctaggatgttcacctgtcaaccgcacgtctatgcaggtatggaacctggctaactgcaagctgaagaccaaccacattggccacacaggctatctgaacacggtgactgtctctccagatggatccctctgtgcttctggaggcaaggtatttggggacaaggcgtctcctactcagtggaagacagcgtcatggaaggagcacttagccagcgtctctaacgtaaaatggcaaacattagccaagatggttttaggaggataatgagataatggcaatctgagaatatgtttccaaagattactttcagcaaatgacagttaaggcatactatctggaagaaaaagatgattttctataagcctgtgggttttttttgttgtttttttgtttgtttgttttttgttttttttttgagacggagtctcactcggctgccaaggctggagtgcagtggcgcgatctcggctcactgcaaccatctcccgggttcaagcaattctcccatctcagcctcccgagtagctaggattacaggcacccgccatcactcctgggtaatttttgtatgttagtagagaggattttaccatgttggccaggctggtcttgaactcctgacctcaggtgatccgcccacctcggcttc

SEQ ID NO: 14887 - DNA, 1839 bp, Homo sapiens
tttggaaggcagaggcgagtggatcacttgagatcaggagttagagactagcctggccaatggtgaaaccgcatctctagttaaaaaattagccagacgtgctggcaggtgccagctggccaagtaatcccagctacttgggaggctgaggcgggagaattgcttgaacacgggaggtggagtttggagtgagccgagatcatgccactgcactccagcctgggcgacagagcgagactccatctcaagaaaaaaaaaagttatcagggtacagtttacctctacgtgcgtttttagtctggaatagagccactcagtcctggtctgtaactgctcttgtctgttgtttccatccctccttaagcgtccttagttgttgttaacccactcatgaccttgacacttagtgaattatccagtgtgttaaacgggctgcgggttcctcactgatttttcttctgttttacctcctttagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtagctgctcacttagctctggggccttgggaagaatctgggcagaagtgaggtggatgcaattggctggtttcccaggggagatccagtccatttgggaactggaaagcagagcacacctacagaagatgtttggcctccctcactttaaataagttactcagcattgctgaggagtgtggctgaacatttttgccaggtgcaaaagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggtaaagtgagccatctccaaggatctcttccaccctcttaaactttgctttttttttttttttttggcgacagtctcactcttgcccaagctggagtgcagtggcgcagtctcggctcactgcaacctctgcctcccgggctcaagggattctggtgcctcagtctcccgagtagctggtactacaggtgcgcagccaccacgcctagctaattttttgtgttttagtagagacagggtttcaccatgttgcccagggtggtctcaaactcctgggctcaggcgatttgcctgcctcgccctcccaaagtgttgggattacaggcgtgagcccccacctgcctatctttgcctttttttttttttttctcggagacagtttcgcttgttccccaggctgaagtacaatggcgtgatctcggctgaccacaacctccgcctcctgggttcaagcagttctcctgcctcagcctcccaagtagctgggattagaggcatgcgccaccatgc

SEQ ID NO: 14888 - DNA, 1839 bp, Homo sapiens; identical to SEQ ID NO: 14887

SEQ ID NO: 14889 - DNA, 1060 bp, Homo sapiens
gcaccaagtggaacaggcggagctcgagctatgccacataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaaggtagatttcaggacccgagattgcagggctgggggattccgcgtgtcgtgtagggaattccgcgtgtggtgtggcaggccggtggcgcgcgagttggcggggactgacagacttctctgccccattgtgaattggggcgtgcggacccgagcctaggcctcaacccgggcgaaccacattgcagatgagaacctacgtgtacatcagctcgcagctgctaggagggttggagagttggaaacttttaaaatatcttttgccttctccttcgtagtgtggccgggggcctacgggccgggcggggcggtgatgaccccaacatgccatctgagtgtcggtgctgaaatccagaggctgtttctgagctgccgcccggcccaaggctcgtggggaggcaggtggactccagaggacctcgtggctcaagtgtcggcctactttttctgcccctggttctccccgtccctatccctgtgttcctgactgcgtttag

SEQ ID NO: 14890 - DNA, 1060 bp, Homo sapiens; identical to SEQ ID NO: 14889

SEQ ID NO: 14891 - DNA, 1478 bp, Homo sapiens
aaaaccctcatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctgaggtgttggcggggcggtcgcagacttcagggtcccctaacggaaaggccaggctccgcgtggacggccaactccctgcccgctccttcagcaggtgactgtctctgccacttcttacctgctgaaggatcttgctcagtagctggaacaatgctgctgtcacacagtctcttctctgaaacttcaggatgctccttggtcaccaggcaatgggagctgtagaccagccgcatgcacttgccccacattcactgctgactggcttcactggaataggttcaggtcaccgggacttctctcagagtcagcggcccacccaactccctcataccgtcgcatctgaaaattttcagagaggaattctctttgtagtcggcttgtcagggttttcaagtttttctatggttatttttaaatctctttttttaaatgctaaaattaatgtcctcattaatgcaagtaattttagagcacagtgtagccatgtacagtttccattatttaaaataaataaatgtgttggttcatttggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttgacatttttccctaagtgtctttatttcaacattttcatatttctactgttaacacccaaaatacttacattctggttaaccctgtattggtaaacacattgtcagaaaccatctgtcaggtcctgctaattctgtttgctggggacttaccatgtgcgaggcacaccatgaagtgcctcgttgaatcctcacaacagccttatgatacatgtgggctagcttaccgccacgtccatttagcagaggaaggaatcagggcttagagagaggttggtgacttccgtaagactgcaaggcagtaagtagcaggactcatgttcacactctggctctgtatgtccttgacttcactactgctcagctcttccttccagcggaatatgctttctgacatccatccacctgggtca

SEQ ID NO: 14892 - DNA, 1206 bp, Homo sapiens
aggggaaagagacaatggaaaaaaacatgagttatatcagtaaacaaacaaaaattaattctagaatgatagaatgtattttatcctaaattacactgaaatctctgaaggaagagccatagtttatagtatttaaaactaaaatgacagatttcagagtttaggcttcctttggtttctttactagctaatgagaaatgatgttgacagtgttgtcgtgggtatgatacctgatggtttaaccatacgacatcgttggtgaaaatggtagatgaaattcacctgtaaaatcggtagtttcaacttaattcttggattcattcatgggaattgtacgtaaaggttttagaaagataaataacttctcattgggataagaaaggttttctaatgaatcattctttaatcagaaacatagattatgtcttaagcatttcttttaatcaagttataaccatatttaatgttctcttgatgtacaagtgctaaagcatttcttatttttaaattatttctaatatgttttattttgtttttttaatttttaagactgctgagaagtcaggccagattgaaagatcaaagaatgtaaggcaaagacaaaatgattttaaggtgagtaagggtgataagtatgtagaccttttcacagggtagggtttttcctttctcactttgtattcaagacatccattactgcccaggcagcatcttttagttaatgtaacccgattaatcacatttgaacacggttatgcttgttcctggttttctagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaaggtgagtatggacacattctcagagaaaggcgtacttctgttttttttaactttttggaaagaattaatacattcagtgaagaagaaattcttctttttcttctttttgtccttttgcctccactgtttcctgttcatcatctgacagctaagctcctcactgttcctggtttttgtgttggactagaatgttcttgagtttacgcatcttctccgttgtttcactcagtattactctgacagtacagtcccagttgtggtctgtttctgttt

SEQ ID NO: 14893 - DNA, 1117 bp, Homo sapiens
gggctcactgcaacctccgcctcccgggttcaagcaattctcctgcctcagcctcctgagtagctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggtaggtctctgagggaagggccaggggaggaagggtggctgggcctgtcttcatttattttgtttaaattttgttgttatatttttctacaaaataataccatgtgattgctatagaaaaccccaagagttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctca

SEQ ID NO: 14894 - DNA, 1102 bp, Homo sapiens
tccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagctcttacggtgagtctgatgtggttgccagtcctgtctgtgctcctgcttgtccttattttgctcctgcctggtatccatcttgtgcacagtaggccattccgctctgtgaagggtctgtcccctcccgcggcctctaggacaggctgccttgagttcttcctccctctcctgtatccttaaattctctccactgggtcagtcctctcagcctgcaaaagtgggcacaattcttcctccagaaagttgccactcctacctgtggttactatcttcccattctttattctttcccacaaacttatggaaagagccacctgcattccctgcttctagggatcctcctttccttccttctttagtccattctgccccatctccctctctggcccattctagccccctctactgaaactctcctcactgacccctgcccacttgttctttcccataatcactatctcagttcatggcctgcagatgacccggcatccaggcagagtcccagatgcatccctcgagggcccagtcctcctctgccctcttcatttgcccaccttgccctgttcattgaactgtgatgctttctgttgttacataatacccctccagttatcctcacctctcttctttccccacattctcctggtttaggccgctagcttcatatggtagtttgttctccataggagagtttcctttgtaaggcaaaaatctaatcacttaattccactagaggacttaaaatccttcactaaccagcaaagtccgtgcagtttgg

SEQ ID NO: 14895 - DNA, 2041 bp, Homo sapiens
tggagccaggcacgatggattcggttaggtctggaccattcggccagatcttcagaccagacaatttcgtgtttggtgagtgcctggtgtggctgagagcatgagggattcattttacgctgggcagtggaggctgaagaggtgtgattgccagagggaaagcatgaagaacatccgcggtgtgccaacttagctttaatatagtgtaaaattgtttgcctttcagctgctaagagcttggtgtcctggccttccttatttataattatattcatgaacaaatattttaacgtttggccattttggtgataatctgaaatagtcttatctgagcattgactcactgatctatattgaggggtttgaggtaaggtatttagtacaatcaccggtgacttaagatttctctttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagcacagtgtgtgtcttcatgtgcaattcctactatgcttttatctcctttacaaaaaaaaaaaaagcattt

SEQ ID NO: 14896 - DNA, 1351 bp, Homo sapiens
caataattctcagaaaattgaccgattagatggtgcacacatcccagagttgaccaaaaaagctcagcgacatctagtggctccttcccacccagcactgatgaacatcttaaagaccaaaaaagctcagcgacatgcatctagtggctccttcccacccagcactgacgaacatcttaaagaagatctcaaccttcgcttacagaaactgactcatgctgccccctgcatgctgtttatgaaaggaactcctcaagaaccactctgtggtttcagcaagcagatggtggaaattgttcacaaacataatatttagtttagcagttttgatgtctttagatcaagaggttcgacaggggctcaaagcctattccaattggcctacctatcctcagctctacgtttctggagagctcataggaggacttgatataattaaggagatacacgcatctgaagaactagatataatttgtcccaaagctcccaaattagaggaaaggctcaaagtgctgacaaatgaagcttctatgatgctctttatgaaaggaaacaaacaggaagcaaaatgtggattcagcaaacaaattctggaaatactaaatagtactggtggtgaatatgaaacattcgatatattggaggatgaaggagatcggcaaggattaaaagcttactcaaattggccaacataccctcagctgtatgtgaaaggggagctggtgggaggattggatattgtgaaagagctgaaagaaaatggtgaattgctgcctatactgagaggagaaaattaataaatcttaaacttggtgcccaactattgcaagaaatacttaattacattgggagcagttcatgatttagtcctcagaaatgggctaggaatagaaaaatcctgcttactcagttacatgttttttgtatttcacaatgtcgtgctaaataaaagtatgttacatgttttcccactaaaaatagaatgcaataaacatcttcaaattattaacaataactgtataaaaaagtgtatctttacagcaatattaaacatacagctactagaaaaaaactgaaattggtacaatctacagagctcattcagatttcacaagttacacatgcccgtgtgtgtttggcataactttttgcaattttatcacttgtgttgtcttggatagccaccatcacaatcaagatacacaacagtaccatagccgtaagagtcccgcatgttaccactttatgaacatacctattccctcttcccccattcctaatccctcacaaccagtaatctgttctccatttcaaaaatgatgtttcatcaatgttgcatagatgaaatcac

SEQ ID NO: 14897 - DNA, 1954 bp, Homo sapiens
attaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggttatttctgacagcatgtgtagataaacatttagcaacaatttaagacaaaatcgtttaaatcagcttggttttgcaacacaaaggaatt

SEQ ID NO: 14898 - DNA, 1232 bp, Homo sapiens
tacaccccgtctcttcacggtttagacttactaaaataaatacaaggtgattttcatcttcaggtagagtgaagccttttaattaaggcgtcacaggtgcagctattctaccttaatgaaatgggtagtgattttcccaccattatttatttcggtgataatatgctgcatattcaagtctcttgtagttattttcacccaaagtagttgacaatttgatgcttctggtgatgtttatggcttcattttatgtaattttttaagtaagttccactagaaacagttcatcttataccttcaaaactgttacctgttctttaaaaaacaaagttgcttgttacttgttctttgtgttttaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctgaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggta

SEQ ID NO: 14899 - DNA, 1100 bp, Homo sapiens
gtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcatattgtctcctggtttttttctttggttgagttcagattttcctcacaaacatcaaaacattttcaaagcattaggtgcacaacaccaaagagtgtattatattcgtgttcctgttacatacatttctgctttggttttcctagtaaaggaaacagataagtaatgagccaactcctgtttttataatgataaaaataaattggttcattgctcacatgatagcttgacaaatcttgggctcttatcctcagtatacccactctttattttcttcttttaaggaactgtttttggcttttcaaaacagtgagtaaaatagattcacagtgtagtttgtgaatcttagtgcatgcaaagcagataaggcaggcagaatggccttgtagaatgcacccacccaccccattggagcta

SEQ ID NO: 14900 - DNA, 1178 bp, Homo sapiens
acaagtcaccattggcctcccagataaagaaaaggtttggtaggaattctgtgcctggttcaaatccttaaaattataaattgcctaactttgcatatgctgattttcccaggattgttttgtgtattaaaagagctcacacgtgggaagggccggcattagggggaggaaggcagatgagaggagaggaagctataccagtaactttttaaacgaatggcaaaaagaccttttctattttagatttctttattgagtccctgtaattctgtagtaggttgtaaaataagacactttttgctttcctttttaagaaaaaaatcatcagcccgatagattactttcccacctgcccaatggactgcaccttgcacagggtctgttcccagcggcccctagaggatgtgccccatttccctgcggggctggtatttgtgaatgtttcccttcggtgtggattttaagggatgggtcttccccgcccgcctcccaccgcaattcatattacatccactcttcttccttgcaggcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtatgtctaattgcttctgttacacgttactttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctcccctgtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcat

SEQ ID NO: 14901 - DNA, 1285 bp, Homo sapiens
ccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaatgtttctctgattcttgtgagatttctcatgggatgttttctctttcgtgtgtgtgtgagatatacatgtgtgtataaagcatctgtacagttcaatggaatgaaaccctgtgtgactaacacctaggtaggacctaacaatttgaccagtatcctccctggtcaccttcacccgggtgaccatttcctcactttgtgtccatcatccacttctccttcaaagaacttattcctaaaataaattacttttagttctacatgtttttaacctttatatcatatcacaaataagcttctgtgactgactgacttcattcactgttaagttttctcttacgtagagttgtaacttactccttctttacccaaacctgtcgtggctgttttcactcctgttttacagatgaggaacctgaagaattaaacacttgcccaacgtcatgtaggtaatttgaacaggagtagcatgaagc

SEQ ID NO: 14902 - DNA, 1172 bp, Homo sapiens
ggaacaagtgtcaagaggtttctgtggagaaaaatactctacaagttacccaggcagttctcttcggtttggagcaagggaacagtaacacagcacaaaactacaccagaagccctccttttaaggagctaagattgtgctgaattctcagtgtaacctgctggatcatggggagtagagtgtccatgcaagcatattcctcagaatacaggttacggaaaatagtttctcctctgggtgaaagttattcaatattcgctttagcgaagaggtcaaattaaattagttagttggcagccagtgagatccacccaattccgaggaaatgactgaggccaaagagggtgcttttcatctcttataattagagaaataatggtctcgttttcctgtggccaacattggtgttggccccaatggcatgttgcccctaaacccaggtggcattttcaccacgaggctccttcatgaattacttgggtccattgtaacgtgcactgagcacttggcctacactccatccagttcctgtgggggctgtgaggacaggaggatgggatgaacctgctcctccctttgaggagaagacttttaaggggactgccatccctaccttgacctcatcagttcttggctcaagctgatgtgctagacggttatccccaaggaggtgcatgaacacatggaaagagacggagccttgagtcagctgggaccctttccccggggaggagagccacccgggaacttcctggtcttggagctccccctccctgacctttctcccatgcctgggccccagtgtagctgtttagaaagacattgctcaacagcacactggctggagcttcacaagcaccattttcctgtagtggtgaatggaaacttttcttagcagaatgcttgactttacagaagcaacagttttctcggataaaactccacgtgcagtgatggattagcagctcacattgtgtctatggcggctttccttgttttaggacagggagagtcatggaaaggtggctggacttggggtagagcttttttctttctcttttaatatccatgggagggggttggaggagagacatcaggggcaagctgggcgggaacgagctgcaggagcccactgcagtcacctgagcaccactggcagggaaagctccgcg

SEQ ID NO: 14903 - DNA, 1199 bp, Homo sapiens
ttaaaattaatgtacaagaggagctgtgatgccagtaatatgacgtccaggtcacagtagcagacaggtgctcagcccagcttacctcattaaagaaataagaaaggactgtgtgctctgatttgtaagcctgcatgccatgaaagaggcaatgaaggctgccaggcacttctagcattttaatggagggaaaatcaaggctgccacagaagatgggaaataggaagtggataggaaattagccttcaccttgtttcatatttgttttgggtccagtccaatttggtagttagtacaaattactaatctaaactgatgatgctactatatattctgcgtatagttaaaaaattatgctcatgtgtatgtatgtatctaatcttcttatataaggtgcatctgtgttcattgcttcgtttactcctcttaataaaaacctcgcaaggtagatcattttgacttcagccatgaggaatgaggtcccgaaaggtttagtgacttacccaaagttgctgaagcagttagtaacatgcctagaactggaactcagctcttctgaattcattgcctgtttttctgtattctgctttttttcatgacactcctttctacgtgggacctgcttatgacccaaaggggagttttggttccaagaatgctatggagagtggagtcagaagattgtggtgttttctgaattcctaacctcaactaaagtgttggtactaactctgacctaatcttaactctaaacaaaatgttttttcgtctttcagtttattcccctatgaataggatttttagagttgtaataatgttacagagacaattttaaacattttattattatcttttaaggtatttttgttgtttaatctttgtaattattactttcatcactataacgtgtatttcagcaagaagaaaagtaaatacagaggtgcagggtaaaaaaacaatgataagtatagaaatggatgagtcacagtaatctatacacttagctattaattgtggaaaaaaatcttttgtattttgaaaaatagtaaaatgaaaactctagtgaacagtaataaattggggggagtaatcaatagatattgaaagtctgctaaggctcttgtcatatttggggataggataaaattactgagtaacttcagactttgttggaaaaaaattagattgcagtacaatgt

SEQ ID NO: 14904 - DNA, 1218 bp, Homo sapiens
cctcctggaataacccaagaaactgttcacattgatgcaattgcacatatgctaagtgcattttaaaggcagacctgaatttatcactttttgagaaatgtattagtccttgttcaataggaatgatataactagggtaaaccgtcattattttattcagggtgcctaaagcagtagaagtgtgtggagctattgcagctcagctctgttcatgagtgttttatgtccagttctaaatcctattcatctgaccctattgccccttttaatactgaagctgaagagagtgatagtatatattccatcacggaaataaccacagagcctggaagatggggtcatgacttggagattttgggttgaattcaggctccaccatttactatgtcatggtacatgttattgaacctcactaagcctcagggttcttagttgagaaatggggaaataataaggattgtgaagattaaagaaaaccatatagtatgtaagataagcactcagcaaggtagcaaaggtactaaacggtgtgtaactattaaccgttagtactgcaagtggcagtgaagtgtgttataggatcatgttatcagtcacaggaactcagagtcaggatagataagtgtttagcattaatttgtaaggcagattgtatagatgaaactggtggtcaatagttattttttttttaatggctggtataaaaatgactactttgggagccacagaccagtcctcaatatctccttgaaaatctactatcatccaagcctcattttcactttgccacttgtaggattttgcaaagaagcaaattcttcttctgtccgttttcttttttctgtgccctttaaatgtgtgtttaaaatctagaccttttgggaaaatcttgttggctttctaaattttaaatttaattggcttttgcaatctacttttattcttaaatctgattagaagtaattccttgctcagtaattcctcagtagttctgaactactttctgtggcttttgtaagcagttgtagttggggttgaatttgtattctgggtcatttggatttgcacaaggacagttaggaaaatgtcagagaaatagaagcagtcctagtggaaaataaattatacaaactgttgggtgcgattaatggaaattaatttaatttcaatactgtggtatctcccaaacataaaggtaagtgagaggcagatacttag

SEQ ID NO: 14905 - DNA, 1387 bp, Homo sapiens
actaacaataaagaaagctaatttatgttttaaaaaatatattttccttaagaaaaactagagcagagataaatgaactggaaaatagaaaaataatacgaaaaatcaaaaaaatcaaaaaaagttggttatttgaaaagatcaacataattgacaaacctttagctacatgaattaaggaaaaaagaccactcaaatttctataattagaaatgaaagtgggcacagctgctgcacatcccggggctcctgacctctctgcgtttgcagcgtagcccaagtcggtcagcactggaggacctcagaagccatgttgaagccccatagtgaagccagggctgccttcattcagacccagcagctgcacgcagccatggctgacacattcttggagcacatgtgctgcctggacactgactcgccacccatcacagcctggagcactggcatcatctgtactatgggcccagcttctccattgctagagatgctgaagaaaacgattaagtctggaattaatgtggctcatctgaactctcatggagcccatgagtaccatacagagaccatcaagaacgtgcgcacagccacggaaagctttgcttctgactccatcctctaccagcccattgctgtggctccagacactaaaggacctgagatcccaactgggcccgtcaagggcagcggcactgcagaggtggagctgaagaagggagccactctcaagttcacgctggataatacctacatggaaaagggtaagagaacatcctgtggcgggactacaagaacatctgcaaggtggtggaagtgggctgcaagatctacgtggatgatgggctaatttctctccaagtgaagcagaaggatgctcactttctggtgacagaggtggaaaatggtggctccttgggcagcaagaagagtgtgaaccttcctggggctgccgtggacctgtctgccatgttggagaaggacatccaggacctgaagtttgggggcgagcaagatgtcgatatgatgttttcatcattcatctgcaagacatctgatgtccatgaagttaggaaggtcttgggagagaaaggaaagaacagcaagataaccagcaaaattgagaatcatgatgggggttggaggtttgatgaaatcctggaggccagcgatgggattatggtagctcgtggtgatccaccacaagccgtcgagatgagattcctgcagggaaggtctgccttgctcagaggatgatgattgggtggtgcaaccaagctgggaagcctgtcatcttgccactcagatgctagaggatgtgatcaagaagctccaccccacttgggctgagggcagtggtgtggccaatgcagttctggtggaagctgac

SEQ ID NO: 14906 - DNA, 1515 bp, Homo sapiens
tgccacctggcacccattaccagtgaccccgcagaagctactgccatgggcactgtggaggcctccttcaagtgctgcagtggggccataatcgtcctcaccaagtctgcaggtgtgcccaccaggtggccagatactgcccacgtgcccccatgattgttgtgacatggcatccccaggcagctcgccaggcccacctgtaccgtggtatcttccctgtgctgtgtaaggaccccatccaggagccctaggctgaggatgtggacctccgagtgaacttggccatgaatgttggtaaggcctgaggcttcttcaagaaggatgatgtggtcattgtgctgacctggtgacaccctggccctggcttctccaccaccctgtgtgttattcctgtgctgtgatggactccagagctcttcctccagcccctgtcccacccccttcccccaatgcatccattaggccagcaatgcttatagagctcactctgggctgtagtgtggcactggtgggctggaacaccagggaagaagatttatgcctcgctgaaacgtggctgtttttagagcctgctgtggcgggagagcccggagcctggctgcccatcatgtggccccacccaagcaagagaagaaggaggaatgcagaacagaggcccccagagtgtatggcaagagggtggcagcttcctttcttctgtgtactctgtttagttgctttagaaaatggaagcccagaggactcccaaccctgtcctggggtcaggaaacagccagtgagagttagggaccttagggcatggggcagtagttccagtttaagcagatcctgaccctggcccttacttgcttcccaatcccctgggccttcctcactggcacctgtgcccgctctccactcagctgtcctgcagcaaacacttcaccctccaccttccattttcccccactactgcagccgcctctgagcctgtggctatagagcctatctctatgtcaataaacaacagctgaagataaagaaagaaagtgggaacattaactacatacttactgaaataaaaaagattgtaagagagtgtaagaggagcaattgtaccccaacaagttggatacactagatgaaatggacaaattcttagaaacgcaaaacctaccaagactaaaccatgaagacatggaaaataggtcacagacctatgactagtaaggagactgaatcaataatcagaaatctccagacagccaggagtggtggtgcacacctgtagtcccagctgtttgggaggctgaggcaggaggatcacttgagcctaggagtctgaggtcagccttggcaacatagtgagactgtgtctccaaaaaaaaaaaaaaaaaaaaaaactccagacaaagaaaagtcccagagctgatggtgtcacaagtgaattcatctaatgttcagaagagagacttaggagggagtctggaccctccccacccccatgctccactctatcctacagccacagaccac

SEQ ID NO: 14907 - DNA, 1162 bp, Homo sapiens
tgcgcctggcctggttggtttttttttttttttattcttttttcaaggttatttgctaattttattcttctcagtagttccattttataggtagagaacacttcagcactccatggtgctataccagactctttcttggccttgttatatattaatggacattttcatggaaatcccagggttgaaaactccccagagttgctaatacctgctactggttctcaagtggtttgatattatatacataagtgtggagcattgctggacccaggttttaataatcagattaatagatacatttgaaacattgtcatattagcttttaatactactgaatttaagtcttctgtgcacttaggtttgctgtaacgcatggttaacatatataggttggtataaatttttctgttcctgattcagatagggtttttgtgtgttttgggttttttctccataagagaaattgttccctttgaaattttaattagttttgaaattaaactatagttgtgcatatgcatggcagctatacctcctgattgctatgctgaaggtagaaagtattctcttgttgtatagacattggtcatactgtcaggcaagggaaatgccactaatttctgtttcttgaattgcataccagaaataggaattcgttgtctgactgttagatgctcagggcagatggaaaagtaagaaaaaccaggacttcccaggaagcaagtggcagatctgtgtgctgactgtttcagggtggggatggcacagagggggcttgcaggagagatgtggccgagggtggaagagcttgtcttcggtgccttgtgataagcgacctgcagcctgttgcaatggcgactgcatttgagatggtgtgcttgtaacatccgccgggtaggcggagcctcaaggacacatgttgagaggttggggtggtggagccaggaggtgcagtgagcgaagcatccaggcgtggatttgaacagctgctggccgcccggagatcagcctccatgcatcagtcataggcacagagaactcatccgtgcggctggaggctgaacatggagaaggagggaagggagctgctttttcagttaatactcttgatgcttccagagcagtttaaagatactgcggaaatttgttgggtggttcattg

SEQ ID NO: 14908 - DNA, 1190 bp, Homo sapiens
ggaggctgacagctaggaagcctacaagcttgcctgcgcccccttgggtctctgcagcctccacctggagatgagcgtcaggcaagagtgtgcataccatacacacacaacgcaggcttggggtcgtttcctgtgaaactcatcaagaccatgctttggaggattaggggtaggggtggtcctgtgtatgttgcatgtttgtatgatctctttgcactggaaaaataacttataactcaagcttcctcaacttccctagcgctgcgagtctctggaatgcacccctctcctatctcgcagcccctgtctgccctgcctgagtcactcacaccttcctgggggcgggggcagtggaagccaggggttcaggggcacagccagccctgggaacacacctgaggtgatgtggaggctgcttttgcctttcttcacgtccccagggtcatcttggtcctcctgggggatgtaacaggtggtgaggatttgggccgaaagaagtcctcactggtttggggttcaggctgctggcgtgggtctagcccattcccggcgacatccctggcatgggcgtacctggtggtgcccctctgagccctccccgctgtgcttgccccacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggg

SEQ ID NO: 14909 - DNA, 1249 bp, Homo sapiens
tgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgca

SEQ ID NO: 14910 - DNA, 2039 bp, Homo sapiens
taaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtggcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtcttt

SEQ ID NO: 14911 - DNA, 1161 bp, Homo sapiens
ataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagtt

SEQ ID NO: 14912 - DNA, 2235 bp, Homo sapiens
taatgatgtcattttgaattcagaagtgaacacacagccccacggctgtgctttctaaacagtagtctgctcctgttttaatggaatatacacctttaaaaattagccacagaatttttccagccacaacggtaggagtgtatctggttttatttaggaagcaatttgcatgtgatctggaccgctggtttgcaaacttttttcttttttgttttaaggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaagtctggtctttccttcaatgttacagcaaaacagatataaaatagacaataaattatagtttatatttacaaaaaaagctgtaagtgcaaacagttgtagattataaatgtattatttaatcagtttagtatgaaattgccttcccagtacatgattgtgaaaaagacatttagaaaatattctaaaatttaatctgagcctcactttctacaagggaaatcatgatttccgttcataaacagcatgctcatccccctaacaccatt

SEQ ID NO: 14913 - DNA, 2235 bp, Homo sapiens; identical to SEQ ID NO: 14912

SEQ ID NO: 14914 - DNA, 1175 bp, Homo sapiens
acctcatagctggtgggggcacagaacgtccagttgtctctctttgggatgtggtcgaccatgacaggcagagcctgggtccgtccattccttagggctgccaagtgccgaggctcattcaagcgtcccttcattttttaaccaagagaaactcaccctcatttatcacctggttattcagcggtacagtgcatataggagaggtgggagaaatgcctgattctttccttttattacagttttccaaataatgagttgattgctgattgtccatcaaagatgacaaatttggttttgagtattgttatgaagtcatgaacagaaacacatttgatggagtccctttgtaccaattaaagtgctcatgccgaactaagatttgctaagcaggacaaagatctgattcttcaattaactctctagtgaggtctgacataaattacagttcctctttcccccgtctctgccttggctctccactccaggcgaccactttatcaagttcttcgctccgtggtgtggtcactgcaaagccctggctccaacctgggagcagctggctctgggccttgaacattccgaaactgtcaagattggcaaggtgagtgaaagcccttattaaactggaaatggactgctttgggctggattaattagcagagtggcccattattcattccgtgtgcaaagtcgcaaacttgatttattaattccatttagtgtgccacttgataattcatttcaccttcacagatggcagtctgattttgagttttgctggcttttccacagcctagagataaattatggcctcggctgctttgtttattttgaagagatggccaaatctgaattggcagccccagagcccgttctgcaaagagatggggtagagccttgtagaatgttcactggacgaacttggagaccgtccacgttcgacctcacccaagagctctctctaaaaggaccctggctctgtgctcccccaagcacgcagaagaccctccctcagtttgcactgtgcctgggattctttccagcatttcctactttatacagagaagccaagagtggtgtctgacaacttctgtgtaactggattttctggaaatatccagtgtagctccagggacatcacttttattcttctacactttccagcacccaccaga

SEQ ID NO: 14915 - DNA, 1175 bp, Homo sapiens; identical to SEQ ID NO: 14914

SEQ ID NO: 14916 - DNA, 1099 bp, Homo sapiens
tatagctggaaacttgaattctcacagtaactggatattcaggccttgtaagagttgaatacctgccaggtggcctggaagaataccttaattgcaaaacaacaccgtgtctgctccagtcctaatttgaacacagacaacaactgctgaagccgggaaagcataacagtagcttgcagggaaggcccgaggctgctgcagaggagcactgagtactgtagcttttgaggcctcagtcacagcagcgggctggaagttttcacctcattttagttttccttgaataaaaccagaaacttctgaaagtttaggattaactgaatgtattatctcctggaacgttatgtttgtttcctttttatcagagaggagcagatacatgcctggctgcagccccttgacagctcattttctgattgtttcactaaatgagtttgctctctgataagacaactttctttttgctctgtctaatcctttgttattctttcagcttaaagcttttcaagccaggccaagaagctgtgaagtaccagggtcctcgggacttccagacactggaaaactggatgctgcagacactgaacgaggagccagtggtgagtgtctacctccttccctccctccctccctccctccctctctccctgcctacatctttggggtaatatgtaacggggcagaggccagttgaggttaatgattaaggctgccattttaaagcaactctactttttttggagcttattggtattacaggtaaagatgaacttttacagaaactttttggtgtggaaatacctaaatgtgcacaaaagtcaagagaaggctaaaccctgagtttcagcagttaccaccattttggtgtttgtcttccccaccaccctgcgccttgtttggctgtagtcagtcttcagggaagtcacttgtgtggcctcacagataagcacttactctttgttaacactgccaccctgccactgtcacaggtaatacagttcacaactgtaccccagcatcagagactgactctggaccacctggggtcagggctgggcccagcctagaatctcctatccaagccagcactggagcctcc

SEQ ID NO: 14917 - DNA, 1099 bp, Homo sapiens; identical to SEQ ID NO: 14916

SEQ ID NO: 14918 - DNA, 1098 bp, Homo sapiens
tcgtctgtagcaaaaaatacaaatgcataaaagctcaggacccagatgaagcatttcaccacctgggcctctaaaataagttggcagctccaacgagaaggtgtaggttgaaaagaggtccctgtccctcacagctttaagcagacctgacagtttcttattgagagagagaatgttccttagttgacatgaaaagttttgatgacacaccaccctaattatcccctaccctctggaagagctgaatccacaacccaattctgggtgacatgtttttgcccttcttgctattatcagtctccactaactgatcatcacgtcatgttaacctgcaaatacaaactcctgagccatttaatgagaccttgatctatggccaacttgaggccctccttgcccatctcttcctccattgaagagcaacatcaaataatgcttccaataaaattgacgcgtctttgttagagatgtcaggtttaggggtgtctggcctctgaagctggctaatgcatgagtccttttctagacaaggtagagggctcattggagtgattagagcaattattcagggttacctgtcatatgtaatcagctctggcccatgtggtgggaagaggtgacctagacctgccttttcagaccaactattgctattggatggcatctttgccttcagcatctccttagatatgctcaagttccaaacatctatcggcaaaacttaactttcttgcatttttaaaaattctattttaatagccctcttactcagaggaggtcatctgaggcttgttatgatttatttttcttctgcaatttctcttttatcctacctgacatattttattgctaaatttcccgtgtgataaagcaagagtccttctgagttaaggaaaacttcttacttcctttcatctcatcaaatcatcctgaagagcagataaaagccttttagtgaaacctggtattactgaagaaggaaagaaattctaaaaccacagaaaatggcttatatctggtgcagaagtttttgatgaggtagactttattgttaatcattatgagccttatcatcatcattatcatcatcatcatctt

SEQ ID NO: 14919 - DNA, 1216 bp, Homo sapiens
agggagaggcacctccaccccacccctgggaaggccgagaggtgcaaagccgcctggacagggcccaggggtcggaggctctcgggcacggttagaaaggggaggttttggtgcctgggggacaggtctctgctccacagcgtggagctgaccttttacacatatttgcctgacatgtcagagaagacgatttaaaactggttctttgttcgtctccaagtcccggcgacagcagcccgggagggtaactgggcctggcccaggcgtcccaggcctagacccaggacaattcgatctcatagccgcggaatgggactggcaccgtctctgggagagtgtggcccgaggccaatctcctcaccctcacctccctcctggccaggtgcggctccgggagccccaaatcccgtggcttcttttaaagctcccctctaattagaagcagcggtgaaatcacttcagtgattttatctgtcatgggaaagcaaaccctaaaccaaacctcagttgcccatcccagagccaccaacgcccccattcttcctttaaaaagttctaaatggaaaagataaagcgctggaagccatagaggagtgggagaggggaagggaactgtgaaagtaggaagaagggggtggacctttgtacagaagtgctaagtctgagtgtgtaagagagagtgtgtgtgagtgtgtgtatgtatgtgtagagtttctctctttctctctacgatgggaggagactaaacctagaagccagaagtgacacagaatcatgaacgtcttcacctattgagcaacagtttcatgtggaatctaacgctgaagtggccccggggttggcagagtcagatccgctaaggccagccgtgccctgcacctcgtgggcgggtggggaggcggggacggcgacctgtccccactgtgtccaggtgcgcggggatcatggggtctggacgcttctagcagtctagcccttccccaacccccgacccccacccgggagtggagactcccccagttcgaaagttccgaggggaggctagccatgggtcgagcttgtcgatgccccaccactggagtgcgaaaacacactcacactcgcatcgcacccagcacatccagcagtcagtcagcttcggttcccgggccagggactgaccgggaaagcgggttggggctgttgggaaaagctggagctgatggcaagattgccg

SEQ ID NO: 14920 - DNA, 1198 bp, Homo sapiens
ccttaagtattgtgctgagatgagggcatttcataagttaacaaaagtctaaattgttgctttttttttttttttttagaaaaacatgggttttggtttctattaaatgtaaatatctgtggttattttgccagaagcctggtcagttttatcaatgtcaaataatataagaaaatcaagggaaaaagaattccccttttttccttacccctttctgatctcttgggagaccaaaagaatgatatctggataggtgtaggagagaatgctatctagatgggtataggagagaacgacatctacatgggtagaggagagaatgctaccttttcttctcttttttaggagagagaacaccttttttgctgtaggtttatgccatggcatgctggcttctgccttctcactgcaacagtgtggccccatgtaaatcatagaacctcatgggacctcaaatctctccagctacaaaatggggaacccaggtagaaagacccctttcattcctacacatacctttctttgcagaagacacaatgcctagaacaatgtaaagacctcccacgctgctagtgggaatctatagagagaaaggcagaagggctggtgagcctggatcatgtactgcccatcaactttggcaagcgcatcccatttcccttgcaggaattagaggcgagagctcctccagagagcaactgcctggagaggaaggccattgcggtccatgtcagtggtctgtcctgtctgattctgcaagggatgcctttcaggataacgtgccatgtcctggggctttgtttctttcctttcttagactctgggcaacatcctggttcagggagaaaggatatcctgcttctaggtaggccttcacaaattacaagtgaattacagcaaacaaatcttcaaatgctctagccctagtagtgcctctctctaccttcaaaggcagtggaaaatctaatcccacgctcgagtaactcccatggttttacacttgagcattctttgtgatttaagatttggcatgtgaatctggttcttatataaccacacagccgttaatcaatatcagctcttctattttttttgagacagagtctcactctgtagcccaggctggagtgcagtggtgcgatctcggcttactgcaacctctgcctcccgggctcaagtgattcttgtgcctcagcct

SEQ ID NO: 14921 - DNA, 1136 bp, Homo sapiens
atctctctgcatctctgtgctggcttccatcaggcaaattctccccagaaagccagaagtagctccaagtgtacttgcttttcacagtggttactcctgggggacaagaaatactttttcctgagagttccagcggcagcttaagggagacctcagattggccctgcttggtccaaattcccatccctggttgggcacggtggctcacaccggtagtcccagcactttttgaggcccaggcgggaggatcccttgagcccaagagtttgagaccagcctgggcaacaaagcaagaccctgtctctacaaaaaataaattattcaccaggcatggtggtgtgcgcctgtacttccagccactcaggagaccaaggcagaaggatcacttgacagagtcagaacttctctgaaaaaaaaaaaaaaaaaaaaacaaaaaaaaacccacaaaaacaaattcctatccataaacaaatcacaggggtgaagaatgctcaccaacatttcttgggtcccttttctaccctgaagccaagggctggggacaggctttggtggaggaggctgctcagggtgacgctgggcagagcaaagcacaggcccactgcaggacaccctttgtcctacactgggtggcagggtgggttaagggttgttaacaagcagcactttgggagactgaggtgggtggatcaccagaagtcgggagttcgagatcagcctggctaacatggtgaaaccctacctctactaaatatacagaattagttgggtgtggtgcacgcctgtaatcccagctactccagaggctgaggcaggagaatcacttgaacccgggaggcagaggttgcagtgaattgagatcatgccactgaactccagcctgggcaacagagtgagactcggtctccaagaaaataaacaaataagcacatccctcctgtgatattagaggggcaagatttagttttatacatatgggtgtgtgagtggatacaacattaaccatttgtacaattttaactgacctaaccgtacccttttctctcataaaaacatgttcaataataatgtcactctattatatttggacaatgcttaatttgcaagggaaatttcttacacattatctcctttaa

SEQ ID NO: 14922 - DNA, 1152 bp, Homo sapiens
tcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccc

SEQ ID NO: 14923 - DNA, 1418 bp, Homo sapiens
cctgttttcaagaaagattacatactctactctgatcatagtcgtgatgctgccagtataatattttatacctgaagcaaaagagtcagtatggagcaaggtctagaacagtaaactgagaggctggagtctaccataaatcagatctgtgatggtggggaggccttgctttctcttgcctccatttcttcatctcttcaaattactggcagttggattaggatctagctcatgtgtgctattttaagacctcagtgaaactgtcccttggcttgctttttctctggttcccccagggatggaaattttacctctgaccactcttgccttagtacctcctcccccacacagttgtgaggaacctgcagagtttagttccttaaaaacatagttgcctgttctatcctttacctgatgttttctatcttacttgttttaaacagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataatatttcctatggtgtcttcattgccagagctggtctagttcatagaatgagatgttgctagatatagaaacttgaaagtattttgttgatatttagaaattacctattttgagtaatttaaggaccaaggaaagttatttgattgtacattgcattgaagcttgtttcaaaaatgatctctgaggatttttttgtttgttttttaagagacagggtctttctctgtcacctaggctggagggcagtggtacaatcatatctcactgtagcctcaaactcttgggttcagtcatcccacttcagcctcctgaatagctggtactactggtgcataccacctcgctaatttattttatttttttgtagagatggggtcttgctctgttgctcaggctgctatcaaactcctggtctcatgcgattctctctccttggcctcccaaagtgctggggtaatgagca

SEQ ID NO: 14924 - DNA, 1383 bp, Homo sapiens
acagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatgaaagcattgtgtcatagtttaatgggcagtgttttttcttagtgatacatatggtgcatcttaacaattggtagtgtcttaggttaaattaaaaatggtagcttgtaaatttatttttctttttaagatagcagttatttattggggaatttgattctgactcttacaatgttaaacttgtaatcctgtgtgaaacacatgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccagggagaagagatgtgaattaaacaaccttcctgtttagtgttacctgctttgtacaagaatgaagtgcaaagccaacttactttattaatccaagttctttttatgtttttcttaacctttattaaggactagtcatcacaaaatatctatttaacctctattttatgatggtgtgttattatgtttgatacctcatacttcttgcttagagttttgtttaacagttcactggctctgtcccaatgtttgtgatgaacacctttttgctatattgtagctcttggagatactaaaagagaattcacagaacataactttagttttatgtgtttgctaggggaagatttcctagcagctgagagcaaggcacagtctctgtcttcatttctttattagatacaattttctatttttatgtgactctagggcataacaaaacagtgacagtttcaagcgttaattttaatgcttcctactagctaaatatcatcttaaaatgattatcagaaaaaaaaataatgcccccaaaaacttttgggggcattatttggtactgggaggatatttaaattagatttttcatagtctattgttttgaactatggattctgt

SEQ ID NO: 14925 - DNA, 1290 bp, Homo sapiens
tgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatagtgtttgttttcctgttttagtgcttttgtagctaaaacttactggaactgcatcacaactacatttgcagtctcagtgggaggtggactagcctgtggttaattttagagcttaaaagtttataagcattaaaaacacatacatgtattagaatcttgtctaacccctcacaaaggatgatggtgatcagcatgccatcttttgaagattaattctaaaattgaggactctggtaggttgttttatttccttcccaaccagccattcatttccaattgttctgcctttgaaactttttgtgaaaattgcctgtaccaattgcattggttgcgttgctctgatttaaatgccaaaaacactaaatatttgtgtagtgctgttaaatgaggtttttgatatttccatcaaaatgaatataaaattcacttgatggattttgtagtgatgttttcacagttgaaacaaacatattgctgtgcggtggacagccacttcacagacatgcagacccatttctttagagatattaggtttaaaacccattttaattttattttgctgaaggtttggaatatataaagtaatggattcacaaaatatgatatcttaaaacatgttgaaagatttgaaagtggtgcatttttacttttaagagcagcaatctttgaaattagtcaacaatgcagtcttttttaaaagtcagttttctcaagtagtatgttgtaacgtaagatgtaactgatataactagattttgactggtaaacttaaagtgctttttatatttgaggttgactttaaaaagccattgagcagtcctcagaggttatggactctcaagcgactaatggaatagtgttctgttgtgaagtctagaactaaagcaccttgtattgtctgcttctaaagtgtcctatagtttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaat

SEQ ID NO: 14926 - DNA, 1100 bp, Homo sapiens
accaaacagtgttacagtttgttacccaatatactttcttagtatttgcagcatacatttcactgctcaaaaaagtataagggttttgtttgtactttaaatgagagaaataaagaaatgagttggcctgtatatcttgtatttgtgatatgagcaacgggataatttgaaatcacagaatgttgtgggaaaggtctttaaagaacctctaatgaagaaaatgtggctgccacattgatgtacctaggctgccactcatacagcaaataattctattttgtaaacacttcgtgtggatccactatgtaaagtgctctaccaagtattttctctagtaagaagtacaagaattaccaagatggaattctttaccttgagtacaccaagagctagcaagatgatttttaaatcctaaaaagtttgggacaacattttgcttcctgattttagttgagagttagcctgttatccctccaaattctcattttcctggttcatccactaaatagaatttccataactgagatatcatggctgtgacatagtgaagagaatacgagactccaagccagcaacacagattgaattaagactctgtcacttgtcaactttttgaccttgagcaaatcacttaacttctctgagcctcagttcatactccgtaaaatgtgactaatacctcatgtagttattgtgaggattacgtgagattgtttatgaatggcaaagcagtatgtatttcacagtaaatgatcaactgatagtctctagaatttttttaaattacattttgcaattgcattaccaattgaatatgttgttttgtaaaattcatcaattttgtttcatttctatattttccttacatatgctttaggaaagaaactaaaaacgttttcttataatcttgcttcatctccttttcactttttctttttaaaatcagcagatctttaagaaccttttgtgaattggtggtggtggaaatggccagtgcaagcaggattaaattaggagttctgttgaccactggttaaaataggaaaagggtagagaggtagtcagccttgactcccttatctattcccacttacttccct

SEQ ID NO: 14927 - DNA, 1102 bp, Homo sapiens
ctgtgttttgttaggactagaaactatactggatgagtatgtatactgcatgtttacacatgctgtgtttctttatatgtgaggcttcactgaccaccgtgcattttgaaattgtattgcattttgtgtgtgtgtgtggtgacaggtttgctcttctcacttaaggagctctggtctgtgtaggcagtacagtgttgttagggaggttgctgaattatctaaaaatgtatccatgaatttgggggaaataatgcttaatatctgaagtattttcagtaaatgtggagatatatcagataatacttttaaattagtggaaacacatttctgagtgaactgagctatgaactataatcatctcttcccctgagtttagggaagttgttttcacattctttacatttattgcacatatactgaacttacataataactcttccctgattttgagaacgaatttagcaatttcctaaaaatcttcctcctctttccatacagatgtcgtatgttatagtttaaacatatgtacaatttgttgatagaatccaaggagctggtttaggaaagaatactcttaacccctacagttatgcagctctaatcttactgaaaagtaaatactttaggcaagtcaggagagcatgaacctcatacatacatttttacgattatgtactgcacccacatgtatctactcttggtagtaacatgactccaccctttttgggaatgtatttaggtggataactgaaacggaaaagcagtttgacacaaatacacagaaagaggaattgcggtgcataatcaatcgtctgagtcccataactgtaacactttttctcttataaattggtagttcctaaaaatcaccactttaaaaattttattctgtcttgctgaattaagcagaaatcactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgctt

SEQ ID NO: 14928 - DNA, 1151 bp, Homo sapiens
ccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaa

SEQ ID NO: 14929 - DNA, 1174 bp, Homo sapiens
ccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcactttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgaggg

SEQ ID NO: 14930 - DNA, 1096 bp, Homo sapiens
atcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaaggtacttgaaatataatttatcttcagatatggtttgcgcaaatttgtttccatgtgtcttgatacctttaaatattttaactggaaatattttaattttgagtgacaaattgtgctgtaaatgtcttatttgaaagacagggtgatatatttaccccaggagttacattgataagagttaccaagagtcttgcagtgattctatcttgaaagattttagaaatgatttaccctgagcacttttctttttctcagctaactatataagtctttacttagtagtacagatgatcatggttttactttgatgttttacttatattgaggttttgtttttcttgttaagtgaaaggaaatcatggttatgctttgttcctcctcatgcagggaaacaggtgtagataatcaaagatagttgtatttcatcctgaaatataagcagaaagccatttagacttgtcttgagcttactagctacacgcccctgtcatgctatgtagctgtcttccagtgtagctgtgagaaccattagcactagagagaagtttcacaaaataattcatatacttggtaagttgatttggtcaagatttataaagtaatttaaggtcatgaaactgtaacttggggtaatttgtggaatcagtctcattagaattatcagctttataaaatgggaaaaagtcatttacttgattagaataataggtaagcatatcacgttcg

SEQ ID NO: 14931 - DNA, 1224 bp, Homo sapiens
gcgcacacacacacacacacacacacacatctccgaggaaaaagatacaaataaagaagatggacaggctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagttggacgccactgtggggctctgagggtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaagtctgtaaaattcatacttaataaacaatttaggacagtcaaaaaaaaaaaaaaaaagaagatggacagaaaatgcttttatttgacagattcctcaagagggattaatagtacacagcagtatgagtgtggtcagcagcagtgaatgtcctatacacatataagctcttaaaagatatttgaaggctaaagaaacacactagagggttggaatgtgtctgtcttgtgattttttaatcctttggctatttattctacataacctaatttaatttgaacatttgcatataaaaatgcctggccaccatcaactaatactctaactttgacttcactaagtttgtgagatgacttttgccatgaacacgttaccctccatttttccaagggagtgtttttggaacctaatcaaactgagaatttgcattcaaaggtatccattttctaacttgcaaagctgactttttaatcagacttcttatctgcaagca

SEQ ID NO: 14932 - DNA, 1145 bp, Homo sapiens
ccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtgactttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcc

SEQ ID NO: 14933 - DNA, 1173 bp, Homo sapiens
tttttttttcttctttttttcctttaataataaaaaagaaaaccaaaacctcctataatttataagctatgtttgactatctacattatatagaaaatatagactctgtttactttataacacacatctttttcccttgataaataactctttaaaatatctagtatacatgccttgacttcttatatatataagtttggttttatacatatacatacatatatactcatgtttgtaaaacacaataaatatatactcgacaatgacagccaaacaaatgccattttggttaaaaaacacaacaacaacaataaaaagcagatgaagtactataaaagcaccaggcagcagacagaaagtcacatttgctagaaacttctccctcccctgggcaaggcacagggcagaatactaaatacgtccaggtgcctgaaagagaaggaaggcagcaaaggaatgggtcagatcacaagcttttgttttgtttcttagcctgggattagaccaagaatcacaagtaagtcattgcgtttataaggaaaaaccaaggggctcattcaacagcttagcccttgtggtggctgcaggggacagtagagacctggaaggggaaggagagagacagtgacctggtgacaactccatgactattgtctagcccctgcctacatctgcccaggcaagcttttgattgccacactaagcatcaagccattgcatataatatgttcttttcatgactctattcactgctggtgtaaacagaaaggagtattcagtagtgcaacactttgggaggctgaatgagagccacagtttcggtggccccctcaagggctccagcaaatggggactgtgacgtgggggagaaaaaggccagtgggccattgccttccactcctgagacagtaccggcttcacctccagatgccactgggaacactgagcccatcaccttttaaagaagcgcaggaggtcttgactcttcctatgagaagtcccagaagccccagtcagtctgggtggggggtcccctgaaactcagagcacgctccagctgctggctcctgtgcctggcggggagaaggtggagaggcgggcatgcctgccgctgagaaagacataataacgctccagctgcacaccccttttcttccacggccctcctctttc

SEQ ID NO: 14934 - DNA, 1197 bp, Homo sapiens
atcctcccacttcggcctcctgagtagctgggaccacaggcgtgcaccaccacgcccggctcattattattattattattattattattattattattattattattgagacaggatctctctgtgttacccaggctggcctccaactcctgggctcaaggcctcctccggccttggcctcccaaagtgctgggacaacaggcatgagccaccacatctgaccttctttttctattaatgtgaaatattttaagatctgacccagggacgcgcgctcggacatggtcctgccccgctgaccgctgtcttcctcccacccgcaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacct

SEQ ID NO: 14935 - DNA, 1116 bp, Homo sapiens
attccacttgtgttgacagccccttatcttctagaagccaaaacggatgctagttctgcaggctggcttgcagctgtcccagcagattggcagagcccccaaaagaagtcccatcagatatggcttcctattttttcctcgcatttgcagaaggtagagacggcttgctttgcatttcaagtagggaactcattatcttcatttatactttgttccttcaacatttctgtgctaggcactgggaccaaaaaatgagtaagaaagatgaataagagctcacagtctagtagaggagaccaatcaggaaaggcgtgattatggaatgcagatctcagaaagtgataaacaatgaaaccatgaaggaagggctgcccaaccgatttgggcatggaagaaagttttgctggagagggaacgtttgagctgggttctgaagcatgcataggagcttgcctattcatcattcagagtttggttcgggtataaaaaatggtctaaaataagattaatggtgtttaatgtggaatctgggaaactgctaatactggactgtttataaaaactgttgtgtgtatatcctgatgcacagttttctgagagaggttcattagattcttaaaataatctgtgattcaagaaagattaagcagaattggagtttagagtaaagaaaaagaaaaaaggcaggtcaaagacaaatctctggtttcaacagaactaagcatatgaacagagctatttataatccctccatccctgcaccctgagacatgggacatttagtcactttcactctctcactcacttactgcaacactccatttagcccagctctttttccccttttatttttcttcctgctaatctccttcctgctcccccaacacacacacacacacacacacacacacacactacgctttttttttttttttgaagttagaaactgcaaaagaagtggaagtatcatcaggattgacttgtctaaatctcactcttccctctgtcccttcctccatatacattaaaagaggccatttgaagagactaaatccccgattttcaatccccatgaaagttcttaacatcaatacaacttcccaactcaaaagacta

SEQ ID NO: 14936 - DNA, 1233 bp, Homo sapiens
cccaaatatacagaatgaaaacagtaaatttaagctattaaatgccagactagctgagatcatacttttatgataactagctttaacatgcagtttatagaaatgtatcatatataaaatgtgggataaacctgagttatgtgtttatagttgaatttctgtaactactatatgacataatcttagaacaagaattacatgcacatatattagtagcataataccacgtggtataatacaacgtagtccctgaataaataaaacagagatcttgggtctctttgttttttcttgatgattacattgcaggaagtgatattttttcatctaacatataatgtattttagatcatttgttttagccttctaatattttgattgggattttaaaatatgaagtaaatttatagttctattcttttaaatgtaacattaaaagaattattaaatctaacataaaatggatagatgtttaatgaaatatgctatcttacagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattcagaatctgttttttataagacatttattctgttggtatccacagaagctttttaatccactaatttatatactgacatatctattatattattgattttaatctctcaacgaaaagtaatttactccactatttaaacaaattaaaaacaattgtttgacacacgtacagaattgtatttcagtctgaattaatttgatgaaggaaataaaatgatgttaggtcacctaggctaggttaattcatttgctattcttagtaataggatttaatgatttctgtaggttatacaatttaacttttaataatgttaatggaaaagataaagttgagagataatctagatcttataatcaggatctgtggtttttggtcatgaacttggctatgtccaagctcttaatatctgaactatcagcagtagttaagtatggacttaaaatttaaataaataccattaaatttaaaaagtcctcttcactattataatccaggtcaagaaaatagcagactttcagat

SEQ ID NO: 14937 - DNA, 1151 bp, Homo sapiens
aactgataaggtaaaaatctcttaatgatgatataaacatatctgtagtgtggtaagaccacaccctgtttggcttttatatttggatcacagtcttgagaaacttgcagtgattgaataggatgtaatctcttatgttatataaaacgtgtatgtgtttctttaaatcaaaacaaaattattttggtgtattagcaaacggaatatgcacagaaaatgtgtcctcctgtggttgttgcatttatgtttgttttttctggtagggggttctctctgtttaatatttgttttagtgttctgtgtagctatttttcttaaatttgtaaactgtattttaatatagaataaattatgtagtgtaattgttgagaatttaaatgtacattgggaatttcatctttatattatcttgtactgttctgatttatcataatcttagtgaataaacctagtacagaggaaccttacttttcattgtaaatatgccggaactttctccttaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtactgagataatatattgcatgcaaaataaccaaatatggagattattatacttccaggatggtagttgtatttattatgtgattctcctttatagatggatgcctctggaaatggtttctttctttttcccagacagaagctgaggaaatggtgaatatttatattcaccctatttatattctgtgaaggccatctatataatacatatatgtataggagttactgtagaaataatccccacactgagatacttattctagaaatagaaatgccaagagttttctactttaaataaaacgctacacagtataatctaattctctgggtaacaggtgctaagaaaaaggggcagtcagttgttaggatagtgtggggaatagtaacaaaggaagggaaagcttgatgccacaagcatatgaagggcatcaacacactcaaaggtcagatctgctaacaaagatggctaagttggtaact

SEQ ID NO: 14938 - DNA, 1107 bp, Homo sapiens
cttctcagagaggctttctcagactgtaaagtactcacttgttcactttctttcacattagtgttttgttttgtttttaaatactcctgcatagagagcactatcactatttgatgtttttaaatcgattcttcttttgttttgtttttgagacggagttttgctctttcacccaggctggagagaagtggtgtgatcttggctcactgccacctccgccccctgggttcgagaaattctcctgcctcagcctcccaagtagctgggattataggcgcccaccactacgcccaggtaatttttgtatttttagtaaagatggggttttgccacattggccaggctggtctcaaactcctgacctcaggtgatccatccgccttggcctcccaaagtgctaggattacaggcctgagccactgtacctggccaaactgattcttctatttgcttgtctcttctgactagaatgtaagcttcatgagagcaagcatggtgcccggatgcccaggatctagagcagagcctggcacacagtaggtgctctcatgtaaatgctgagtgagtgagtgaatcatgagctctgaagctggaagcctaggagagccttgggggtcagggacagaggaaggaaagagatggggcaagaggcagggcagggacaaagaaggaattggtgaatcgtggtggcagggctgaggaagcactagtcagggcaatggattgaacacaattggccttcccagactgagaatgcagccagtgtaaggattcctggaagagctctgggtcgagtaccctctccttctcctcatacaacagggataggcttatggagctcattatccctacgatggtggagactgggaaacggaaccatcttcccttggtgtagagaaactcatggatgacaagttttcttttaataagttatctggataattgggggccaggtggaaaactcagctacaaagttgatgttgagaaggactcattcatcttttatggaacgccctttcttgtctttgcaagagccggacattgtgttagataggatgtggactctccagtgtggccaacctggctttttagggactaggagttctc

SEQ ID NO: 14939 - DNA, 1162 bp, Homo sapiens
atatggcatgggctattattgctgcaggaagggtacctgtcaagtatgtagagtgcaaaggacccttccttagatgtctagctgctgaggccccacctgtgtggggatgggcatggaggcacctgccttgttcaagaagcctgtgaacagtgaccagcagtaaaagccagagagatcttcaaatgtagtatcttaataatgggctttttttttctagttcttctttttcccttggggccacatgagcatctgtacacctattgtaaacccattgtgtcaaggaaacaaagtaggtcagaaacaggatttaggaacccaaagaaataatctttgttgatgcttaaattgaatgaggcagaaacaaatgtctctttaatatggttttttttttttgggggattattttggtatcaccccaagcctgtaattccctccttagtcatcatcttactatcccttgggactctggcctgggattcttctgctttgtggttgtgattaatcctgcaatgagtgagttggggagggatgggcctggggaagtcagctgctgctagcagcaagcaggggtagggtttatagggagagttgacatcctgctgggatctaacagaaaagtttgaagattattgtgctgaaataaactagctcacaattttgctgtttgactcagggcaagctcactgtaaatctcaaggagtactggactgtatgatggcctcttttgctgtccttatccccactggaggatgcacagattagttaatgtctccctttcatgaatgcagcttttatctttaataagcgggttaaaccgcatgcgctctgtctagtctgtgaaggtcagccagccattcggattttatcttcccatttctagactgctgacagagttcttgtgcaaagttaggaatctttgggttttaaaatgttttcttcctttgcccatccatgacatgcccttattcttgaggggaggaaaaagaaggcctgagtctctgttaggttgcaaatattgtctattttttgggagtgatctttgtagaatctgggcagtgacttttgttgttttgtagtcctgatgatttaaaaaacatatctcatatatttctttacatacagctcagagctcaacattgaaatagatgttcagcagattctt

SEQ ID NO: 14940 - DNA, 1102 bp, Homo sapiens
gactggattgtaaattccttgaatgcacagcacccatatctgctgtatcctttgagctcccaagggaggcagcaacatttttaagagctccgtacatatttctgttgcagtgtacattctggcattgctcactttataaaactcaagtaaaatgatccattatccttctggttgtgggtataacaacacctttttctgaactttgtcaggaatataaaactattactagttgatgaacgtatttgattttggggcgtataaagaagtgagatggttgtgtgttgctttcattctttttaacagcctgtggattcacttttctttgaggcctgttcagaaaggtcattgcccctttaccttatgggtgtaattctgacattgagaactgggtcgtggtcacacagtacgtgttcggaaattcctttaaaataaagtttattttgactctgaatattgccttgctttctattcagtaactcctctcttttcttatgtttcttcaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatggtgagttgactcttggaatatctcattggaatgtacaatatctctgggcgtggacttgttcctgaattggatgtattctggcagcttgtgcttcctggtctaggcacctaaaggcagtctgtaggctaggtgaatctgcactgcagacatcctgttgggtttatagggttgtttttgtgttcctttatgtaccgcgttatatagtggacaaaatacattagtctgttctgtaggtcctgtcttgctggtttttctatatgtatgtctttccacactggtatgtgagcagaactctttgatgatcttgctgaaatgtggagtctttagttcttgtccccgggttgtataggaaatagcctaaatctttctgtctactgcttttcctgctctctggctcagcggctttctcatctctccttccttccttgctgggcaggttcctgcagtgggacagctttgcata

SEQ ID NO: 14941 - DNA, 1192 bp, Homo sapiens
ggtgatttttgcatccagttaacctaatcaggacatcaaagtaacttccaaaactattggaatttggggaattcatatccaccataaggaatgaatattccttatgaatacaacacagtgattttatataatgaaatgttatattctgtttttacttctgtcttctctgtctttttttttttttttttaagtctattaatttagagtaatctctcttcctcagcagtgggtaggtgtttttattttattatttttttgttccatccttggaggtgtttgttttttttctcaagagatattcagatgagattttaaaaatccttatttgttctattttgcatcttcttcctgctgggggattttgcttgaaatacgttcaaaaggcacagatgatcttgggagcatttgaaaaataaatttaaaatggcagtagagatcagttgctttgttttttctcctcggttttgtttcattgtggtgttccttctggaaagggtgagggtcaaggcctgtgtttatgagctgtttttcttattccaccaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatggtaggtccaccgttgaacttggataagaaaaaatctaaagctttgggtgagagctggaagagagcctctgctgagaagagatgagatgaaggcaaagctcgttctgggtacttctccagggccagacacttcatgggcaaagggattattagtgtagcttagtgtagtccagggtgttctaggtgagtgcagatactctgatgatgtggagatgatggtaaattctataagagctgtagataaacaggcatcagaacaggaaaagaccagatctacatggggatggtcaagaagatttggtgaaacaacatctgtgcccccctttaattactaatgtgattttagcaggtggatatggtataggaagaaaattatcattcctcctatggaattgcacatacattctgaagtggactgattttccccttgcgtgtatagtgtggaggaggaggataaaaggcaggaacaatag

SEQ ID NO: 14942 - DNA, 1137 bp, Homo sapiens
aatttataaagaaaagaggttaagtggactcacaggtccgcatggctggggaggcctcaggaaacttacaatcattgtggaagtcgaaggggaagcaaagcacttcttatatggcagcaggaaaggtagagcgtgaggtgggaaacacttttaaaccatcagatctcatgagaacgcacttgttatcacgagaacagcataggggaaactgcctccatgatccagtcacctcccaccagttccctcgctaacacatggggattacagttggacatgagatttgggtggggacacagagccaaaccatatcagtagtttgcgtggtagtggtcaaggtagtgatttcattcttgttttctccttcctttctagttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtaaagtccagcaggggtgcctacatgtgtgccagaccccagtttcccacttcacttcaccaagctaaaaattcatcttcagagggctcaagaagcaggaggtgatgcccagaagcaagacagggacagacagagcgcacctttgcatgagctgcaggcgcctgcaccttttgtcctgcgaagatccatcagttggatttgcattcatccctgggtgccactgcattcaccaagaaagtgaactcacttttttacttaagccttctcccacccacccaccctgggctccagatgagcggtagagtggcagggaacatgtttttctcagggtaggttttgaaacacacctgcaaatgggatagttctgttaatggatgatcctggtctacttttctgttctttttgatgtgacaagttaacatttcaccacctggcctttgaagcagaatatgtgcatgctgtgtgcactgccgagcagtctgtggaactgggtgtggctgggtggcacctcttccactgaaggcatttg

SEQ ID NO: 14943 - DNA, 1811 bp, Homo sapiens
caggtcatgctgctatgtggagcacagaaatagcagacatgacttttcttggaacagggatatgtgtgtgtgtctgtctccacttcccccaaggaagcaggatcttgctgtcatcaactctgagaagctcaggacaggtgattgcatggcacgtggggaggtcttcattgtgaaacaccaaatttcctggaagagcaatgggaacgtgaaaatgcacccaggaaaccccgctaggaagcgcctggggcagtttgcatacttctgtgacgaaggataggtatatagtggattctgaaagtggacatcgctgcttaattcttggatgtgtattttgcttctctttgctggtatttccacatctcttcttatcacactacaggctgctggctctgttcatccccagcatccagggtcctttctcacgggtgggccggtcattttagtggcaggtactaattctgcgtttttttccacctctgcttctgctgctccacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcataggtaggtctgggcggggggtcagggggtggtgcctgccctcctgcccccagatccctgcagttccctcacagtcttcacgttctcttcccttgcgaaagctccagttccgcttccctgtctcgggagtagtgggcttctcagctcattccccctgcagcccttcttcccaggtcctgggcgttggtggcaggataagaatggtattgagctgccgggcgcggtggctcacgcttgtaatcccagcactttgggaggctgaggcgggcagatcatgag

SEQ ID NO: 14944 - DNA, 1465 bp, Homo sapiens
gaaggggaattgggagttggtaacaagcatgtgtcaaagctattctaggtgacgctgggccgtgggtgcagccaggacccctacccactcctcaccagggagctagtcttctcatgacacccgcctccatgtgacaacacatgtaccagtacatggtacactgggatgttcctccctgtatgtctgtctggccagctcgcatccttttccagccaagccccagcttaaatgctgcctcctcagacgctccccacctaaaatggtagtccctcgttccacctgctcttcgtagcaagtggtcatgacccatcattttgtaacgcccttctctctgtggaccgggagtctgctgttcaccactctcaccccagagcctgtcagagtcctggctcatagtaggagttcaagaagtacaggttgaatgaggaacatcttgttcgtgtctctttcactaactgtcccgtttttttccccttcgctgtcccagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataaggtaggggcctccgcagagcagccactcccagctgcaggagtgcgggaggaatgagagaggaagtggagcgtgctatgcactggacggtgtgttctctgattccctggggtgatgagggggcgggccactgtgctgggtgatagcgctgtattagtcctctcgtgttgctgaaatactacagactggggaattcataataaacagaaatgtactggctcctggttgtggagcctgggaagtccaatatcgaggaacctagtgagggccttgtgggtgcgttgatggggcagcaggagacccagtgagggaggggaagtccactccacgaagataccacgagtccattccgcctgcctagggcctcgggtttccttttcattaactggcttgcgtgtgcgtgttgcatgcacgtgcacacatctccatatgccagggataagtaactgggctgcatgcttcgtttcccctgcttctc

SEQ ID NO: 14945 - DNA, 1219 bp, Homo sapiens
agatgtgtgcacgtgcatgcaacacgcacacgcaagccagttaatgaaaaggaaacccgaggccctaggcaggcggaatggactcgtggtatcttcgtggagtggacttcccctccctcactgggtctcctgctgccccatcaacgcacccacaaggccctcactaggttcctcgatattggacttcccaggctccacaaccaggagccagtacatttctgtttattatgaattccccagtctgtagtatttcagcaacacgagaggactaatacagcgctatcacccagcacagtggcccgccccctcatcaccccagggaatcagagaacacaccgtccagtgcatagcacgctccacttcctctctcattcctcccgcactcctgcagctgggagtggctgctctgcggaggcccctaccttatagatgcacttgtggaagtcattgaggacgcctttgtcctcctcctcttccttgaccacttctttttcctgagcgaagagtcgccgccggccagtcttcaactgggcctggcccacctccttgagcttgctgcggaagccgttcctgggggccacgccgtggatgagcccattcttgggctcgaagcggggcagagggtggaacttgtggtggtcgttctctgtgtggccttccagcggccccttgcgcttctccaggatctccttctccatcagcacctccttctccagccgccggtgctcctctggggacagggagtcgtaggagagtaggtactggcagtaggcctcctgcagcttggccagccggtcctgggcagttctggggatgcgcagcatgtctgctagtttgttccattttttgaggtcagtcacttgctgcatgccgcccatctcattaatcagccggaaaaagcaggccaggtcgagctcacagccccctgggacagcgaaggggaaaaaaacgggacagttagtgaaagagacacgaacaagatgttcctcattcaacctgtacttcttgaactcctactatgagccaggactctgacaggctctggggtgagagtggtgaacagcagactcccggtccacagagagaagggcgttacaaaatgatgggtcatgaccacttgctacgaagagcaggtggaacgagggactaccattttaggtggggagcgtctgaggaggcagcatttaagctggggcttggctggaaaaggatgcgagct

SEQ ID NO: 14946 - DNA, 2178 bp, Homo sapiens
cgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtggaagatgactgaatggaatgagctctttcttttctcgtccacgggcagggggcagaggattccccccagccagggagcagagccaccccccacactgcagtcctgctcccacctgccactgggtccccttcagcctaacctaatggtttccatgtggcctgcggccgtccccctcatttcccatcgagctgcgcccccctgctgagcttgctttcatgatgagacgacactgggtgcattcagggtggtatggctgcagacagacagaccccctcatcccggcggggagtctgtcccctctctctcattgggctggaggagtgatggcaggaacacatctccaggggaccagtttcttttcataaagaatggaggattgctttgggcttgtttctgttcttttgggccc

SEQ ID NO: 14947 - DNA, 1112 bp, Homo sapiens
tgctttttatgttgttgaagtcttattagaaatagcccaggtggtttgatcatgatacagtgctacttgaaaatatatcaaaggtaaaaattctctcaactataccttgaatgtctttttccctgtagacttctgtagagaagtacaattgtgttttaaatgtctattttgaacttgatgggataccattaatctatatgtggtttgatgtgtaacttacctgatatttttgttttaactttttaggtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggt

SEQ ID NO: 14948 - DNA, 1266 bp, Homo sapiens
gcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagcc

SEQ ID NO: 14949 - DNA, 2177 bp, Homo sapiens
aagttgtgtgatttgttggaggtgtcaagtatgtactatgtgtcagtggagaaaatagttttctttagattaaaagaccagaatattttaattctttgcatgtttttatatgtaaaggtcagagtctttaatttaaaaacctatcatgttgcggccgggtgcagtggcttacgcctgtaatccagcactttgggaggccgaggtggacagatcacaaggtcaggagatcgagaccatcctggccaacatggtgaaaccacgtctctactaaaatacaaaaaattagccaggcatggtggcacgcacctatatagtcccagctactggggaggctgaggcaggggaatcacttgaacccaggaggcaagggttgcagtgagccaagattgtgccactgtactccagcctgggcaagagagcgagactccgtctcaaaaaacaaacaaacaaacaaaaaaacctatcattttgccctaatgaagtatttctgctttaactattgcaggttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtaagagaattttttattgaaatggagaagttacattggtaagggtatgtgcatgtatatgttttgtttttaaaagtcatcaagattccgtatggtttgggtaaaattaaatatgttctccaacataaatttaccatactataattctggaggattatattacagtttgagaaaaaaataacagtagcgtgtgtgttaggtgtagcagaaaatgtatataccaatgtgagtctactccccccccacccgaccccccttacccttgtgctgctcatggtaaatgttagcatttggaaattttgctcagagcatcatgtcacattatgaagtttttatttttcacaggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctag

SEQ ID NO: 14950 - DNA, 1178 bp, Homo sapiens
ttggctttcacagtgtttacattttgtttgagaggatcagtacattgagtgtctatgtggtgtcttttatatttttgtaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctggtaagtattaactttttattattattattattatttttttttttacaagttgtcgttttacaagttgccttgacagatgcagcaagtcaattaatggtttacactgaacatagttgagaaatacagaactctttgggaaggaacctaggattttcagtttgaactgctctttaaaaccctcatgattctggtgaagtcatctgtggatctaat

SEQ ID NO: 14951 - DNA, 1228 bp, Homo sapiens
attatgatgcttaataaatgtctgttaaatggctagcatgtaacaaatgtcaggaatgtagtaggtgtcaagttagattgtgaagtggatgtgaagtagatgcacttctgtgcaaaagctatcattcagaggcagagatctatgctttcaaatcttgaaattcatatggtctgtggctgtgtattttatatgttaggatattgcctacaatttacatcttatgtcttagaatgcttgctgctttgaagaaatttgaaaaagattcttaagaaaaatttagtctttgagcccctaatttgcgagcatgattttttttcttaaaccacagcagttcaaacatgtggttaagggggagctcaccagtgagcaaggtgattatgagctgctcatttataaggttaaaagaaatcatttataaggttaaaagagaggtctattcttttttttaaacaatgtaaatatgaacagttgtctatttctggcacattctgtgttttaataggaaatattattagaaactgaacacttaaacttagcagtgccattaagatactgacatactgtaaattaaaattttcatgaaatctccccccactccccgtttttttttttttttttaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggtaaggccaaaaaaataaaaataaaggtgatggtaaagcgcctttttgtaaggccatttaaaaatgaagtatttgagaacagcttcagtgttcactcattctctcttgaaaattaatataaaatgagattatcctgagatgttttagttatatctgtttctgaatattgtaaggtcatattagttgcttgtcaacagtgaggtatcttttctccaggtgggaaaaaaaatttcttgtgtcattgagcctcagagagtttttgttttttgtttttaactgctagccccctaggtgaactgttctttgtttttttgtttgtttgtttttttgtttgtttgtttgtttgtttttgagacagttttgttcttttgcccaggctggagtacgggggcgcgatctctgctcactgcaat

SEQ ID NO: 14952 - DNA, 1110 bp, Homo sapiens
gtggcgcacgcctgtgtacacaggaggctgtggtgggaggatcacccaggtctcacctacagtgagctgtggtctgggtgacagagcaggagtccgtctcttaaaaaaaaaaaacaaaaaactgtaaaaggtttgatctgtagtgctgttttgaatatagttccattttgtatgcatgcatgtgtgtgaaaagtcattaagtctggaatgaaatatagagtatccgtgaagccattttagaattatatgtgtgtatatttatgtgcataggtatatgaatacataccttaggttccattattatcagtttttcctcttatttgtttgtatctactgtatatttctctgggaaatactcatggtctttaggtcatgttagctattgtcaaaatttagatatgaatcattgatttatatgaaaataaatgtttttgatttctctttacctgtaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtgtgagtatatgtatatttctaccagtctttgaatattgattagaataagtaagactaaataatgtaaaatataactaccattgtattctagcaactgtataacacataaaggttgtgaattagtgatgattatgaattggtatgcttttaaaatagctgtcaccttgatcaaatttttttttttttgagacggagtctcactctgtctccaggggtggagtgcaatggcatggtctcagctcactgcaacctctgcctcccgggttcaagtgattctcctgcttcagccccccgagtagctgggactacaggcatgtgccacctcacccagctaatttttgtatttttagtagagacagggtttcactatgttggccaggctggtctcgaactcctgacctcaagtgacccacctgccttggcctcccaaagtgctgggattacagatgtgagccaccgcgcctggccactaccttggtcagatcttaagttagtgttgactagtaaact

SEQ ID NO: 14953 - DNA, 1404 bp, Homo sapiens
cttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcagattttaaaacactaatcatttgtctttaataaccctgcctttagtttcaaatctaacttaccatatttctatgtgtgcatgtctctgcagtgttaaaaataataatatcagcatttattaggggtcaactgtgtattaggcactgttctaaacatttgatattcattatctcatttaatcctcacagcaacagacccataggtactgtggtcattaagtgtttgacaagtagaaaactgaggcagagaagttactgatggagctgtagcaaagccaggatgcaggccacacttcgcttgtcagtctctgtgttcagcctggtgacatgtcat

SEQ ID NO: 14954 - DNA, 1186 bp, Homo sapiens
atgaaatagtatccaatataccaaaggtaaaatatatgctactttaggccgggcgcagtggctcatgcctgtaatcccagcactttgagaggccgaggcgggtggatcacctgaggtcgggagttcgagaccagcctgaccaacatggagaaaccctatctctactaaacatacaaaattagctgggcatggtggcgcatgcctgtaatcccagctactcaggaaggctgaggcaggagaatcgcttgaacctgggaggcagaggttgcagtgagccgagatcgcgccattgcactccagcctgggcaacaagagcgaaactctgtctcaaaaaaaaaaaaaaaaaaaaaaaaaaaaaaatatatatatatatatatatatgctactttaaaaaatatcagtatctaaataatggagaatgtgttcattctccagacttctaaaacgttttctcaccacactttggatgaaaacgttgttcacatcaaagtattgtcacttccttcctgtcctcgtaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggcaagtaactgaatatctggaccgaggatgaaagcaccagccttcacccccaatggacagatatgaatttacttaccaaacacctcactaaatctatcagagaaggagcacttgagccatctctattgaaaggactctggcaaaatagtaaccaaaataaaaataatgactaacttttattgaataacccctacttgccaagcactgagcctgagtaatttaggtatattatttcatttaatcttcaagataaccccctgaggtaagtactgttgaaatccccattttcaaatgagaaaattgaggctgatagaagttagctaactcacccatggttacacagctaggaagtggtacaaagtcggatgtaaagccaagtagcttgactccaaagcacatatgcttaaacacagacttactatctccctaatttttagacctgagttaacttttgaggtgacaacaggtcattcaagtgaaaataatccactaagtaatgcaactataagataaga

SEQ ID NO: 14955 - DNA, 1122 bp, Homo sapiens
ggtgtgtcagattggtgggtcagagaactgtttgctcagtgccagaatgttggaaaacaaaagcaagtttctaagtaaccccaaaatagattcacaggcaggatcaagaagctaatgcagatgttccttattttttagaaagaagatctaaaagccttatgcaactatgcagaatttctaaaatggatttcataaggtcgcaacgttactaaatgacttgtttattcagccagcaatgctttagtctggctgactcttggtgtttaattgcattagttctatgaagcattttgtgatgttgttcaccgatgtacaaggcattcgggcatacaatacagtatttatgcaatatttaggtgattttcaaaatataagcctggtgccaaatatggatgtaaaattttaaacagtatgtctaccataaccccatttgggaggggaaaagttatgtgtgtgtatctgtgtgtgtgtctagcatgtgtcggtggttctcaaactttgacatacatcggagtcacctggagggcttattaaaacacagattgctgtgtcttcccctagagtttcttattcagtaggtctgcagtggggctcaagcatttgcttttccagtgagtttccaggtgatgctgatgctgttagtctggggaccacagtttgggaaccattgtggggaacagaagcatagaaacaaatctagaaggaaaatttaccattattgtttaacaatagttatcttatgtctggataatgggattactggggctctttatttttcttttatactttctgcatttttttcccattatcattagaagaaatcgcatttaaaagtttttctgaggctctaatacctacgctgtcatgaacacacagttgttactgtcttctattgtccagtcttacaatgttgtcatttatgaccacagagcttcatggaaccaggtgaggtggtgcatgcctgaagtcccacttaccagggaggctgaagtaggaagatcacttgagtccaggagtttgagaccagcctaggcaacatagcaggatcctatttctaagaaaaagtttaaaaataaataagaacaaagcatcaagaatgcaatattttgtgtccctggtttt

SEQ ID NO: 14956 - DNA, 2481 bp, Homo sapiens
gtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacgaggcaaaggtgaggggaagatcagcaggtagctgtaattctgtattgatctcaactgatttttgaaggacaaaatagtaaaatagatgtggaaaaaatgggataaaggtttatgatttatggcaaaataatgtttctctttcattacagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtcatgcatagagtatttggaagtgaggaaatggagttgttctgtatgaaagttcttgatgagtacgcacacttattaaatggatgtatcaccactacagtacagagtacatgtgaaagtctagttttttattagttttacacaaccagctattcatgaactgtagttaaaacattgtaaatctgtatatttactgctactcaattacaaaatcttcagatggcattgaaaaaacatatccaaagtaactcaagaaaaaagtaccatggcttcttaaacaaaaaatcaaa

SEQ ID NO: 14957 - DNA, 1120 bp, Homo sapiens
tttcctgcttaagttaggccaaagttggtaaaatgcattttagaaccctatttttgttaaggagagcacagagccactggtttagagaagtttgtaatatccagaggatgaagaaaacggacacttgtcattctgagttcacgggaacgggagaaactgaacccttttaggttgatcatcagcttgatgtgaagggacttgagagattctctaatctattctttcctttaactggttaggaagcagagtccaagagaaatgccctgcccagggtctggcagaactgatggagagcagccttcgtggctaccaccttcccataaagtctgtgctctccagcggcgcttggtaataagatttatttaatgacacgtgtaactctaagactatttgtgatggcgaataccacagatttgactgggtaatgtgatatttgttatttgctttaagttaactttagcctttagcacagtgtgatggaaagggcaccaaacttgtgatctagaagacttgggttcaagtttcagatttgaattagctttgcttctgcaaatctgaggaccctattttcttaatccatgaaatgggaataataatactcacccaatttaccttacacagtcgtgaggattcattgtaatgggctttgtaaaaatataaagtgctatataaacataagggtgttaatctcctgtctttggtgacaggctaaaaagacatacttgtttcaaattttggatactctaatttgcataatcttacacattctctttctctatttttaactctatgttttccccatcagatttttttctgttaggagttacaatatctctcttcaactgggctttgcctcaaggtgtataaacttaaagcattatctccggtgcagtttgtcagtgtctcggcatatttgaaatttttagtactgcatttggtatatgaaagctgcatcctatgtaagaccataggatatttaaacagatgttcaaatttctattgtgaaaatcctagctcattccttgctagagatgaagcactgaggacagtacaatcaccaccttaaaacaaaccacctaagcacagctttggctgcacagattggaagggaatctggtaa

SEQ ID NO: 14958 - DNA, 1185 bp, Homo sapiens
agtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtg

SEQ ID NO: 14959 - DNA, 1969 bp, Homo sapiens
gttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 14960 - DNA, 1210 bp, Homo sapiens
cgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattcctta

SEQ ID NO: 14961 - DNA, 1112 bp, Homo sapiens
tcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaa

SEQ ID NO: 14962 - DNA, 1157 bp, Homo sapiens
caaatgaccaaatattaagttcttatgatatcacagtaagaaagtagggaattcatttgctgtctttattgcaggatcttgcttgttgcttttatgccatagtagatgctatgctgtgttgcctagatccattcttcaagtatgggtgggaagagaatggcctttcactttacattgtataagagggccaactctgcttgtagtgaataaggaaaacccatttgtttgagagcttccactgaaagtttgaacgtttttgttttattttgtttgtttttaaatcaaagaatggtcatatgtgagttaagcacatctttacatgagtgaaaatatctgcattaaatcgaagttggatccttttatttttctctccactcctccatcttctgttatcagttattttacattgcaagtaagcacgtactcaatgttaagttgaaaacttggctcttctttccttttcattatgaagtactcattccaaatttcaaagttcaaactcacagcatagacatatgaagcttacataggtttgcaaaggaagggtaaaaggtgatagaagaggaagagagatttttatgattaatactctggatcgtctatgcagcatacattttaaccttgaacttcttccagaattttcttttcatgggctttatggccaactgcctccagatagacacatttctttctacaaatatccttttaaatttgatacttgggccatatgctatgctgtttcactctgattttcaggcagaactctcctcaatctacatttatagtcatgtaccatataatgacattttggtcaatgatgtaccacatacaccacagtggtctcataaaattataagggagccaaaaaattcctatcacctagtgacattgtaatgttgcagttgacacattacattttctgtgtatagatatgtttagatacataaatacttactagtaaattaaaagtgcttcctgtgttcaatatagtaacatgttatacaggtttgtatcctaggaacaataggctatcccatatagcctaggtgtgtagcaggttataccatctaggtgtgtgtaaatatactttatgatgtttgcacaacaacaaaattgcctaatgatacatttctcagaatgtgtttctgtagttcagt

SEQ ID NO: 14963 - DNA, 1199 bp, Homo sapiens
ccatgcctggtctttaaatattttcagtggtggcaaatcttcatactccgaggtcggatttgatttgtggaaactgacaaaagttattctgaaccaaagctggcacatgaggtacgggtgatcaaactggctgacagtattttggtcagagcaggatatgacagtttcttatttaattttgaaaactactgatgaaatctagaaataataataatagctaaaatttgtggaggttgtatcatgggtcagacactatgcttagccctgtgcttatcttatcccttaatacccagtgtcaattaatagggaaaatctacacttaagaaaacagcatcaaatggtactttattctccctctctttcccaatttatggaattactcatttactaaatttgcctggccttcggcttcactctgttttgtcagagtctagtcatctttccagatgcagctccgggcccatgatctctgcaggcccttccctgactccaccagcagagacttctgctgcagttgctgtctgacctcgtttggctcttggtcatcatacaccaaactggatggtcttgtgggcctgctgtattttcccacctagactacaagcacctggggctgggaccatgtctcaggtttctttgtctatctcacaggtgcttgatacaacactgctcactatacactaagttactgctctgctgaggctcctgagctgatggaaggcagccccatgagaagtttctgaaatacagagacagtgagagcactacttacttaagtagacgccggatcctaattctagtttgttacgactaatttcattactgaatgctcttatgccacagaaaggaaggaatcttcagaacataacttgtacccaaatctcagaaaaaggccactctgatcatcctctgattgtcaatgcccatttttgaaacataacatctgatttatctttacacccagagcgttcaatgcccccaagctcaggtatgtgctggaaaagtgaagtaattttaacactaacccaggtaaacaataattaggaaggtacatttgcagtgttttacaaaaaggaataaaatataagttacttttagattatatataccactactctcaactgatgtaagctatagttgatatatgtatagttttatataatacatgggttcttgacaatgcctaatttttgaaacaa

SEQ ID NO: 14964 - DNA, 1350 bp, Homo sapiens
tttttttttttttaagttagtgggcaaaaggctatgtgtatcttagagagtattcttcttcttttcaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtttatggtttgttttagtatgtttttgtgtccatgatgagattaaattttttatctgcttcctgcttctggctctactgctgcttcttcctctttgtgtagaagaaaacagatttccatttgcttctcactccaccaagaattaccaagaatatatctgcttcctttgtctgaaaaaaagccagcgagaataa

SEQ ID NO: 14965 - DNA, 1152 bp, Homo sapiens
aggcacaagggatgaggtttgtgcgctccaccgacctaggtaatggagccggaagcgaggacagcgaaagcgtacttccatctcccagtcgttctcggccaggaagcactgagccactgcggcatcgcagcttgcgaccgaggcaaactccacacacagaagtcgccgctttttcacctcaggctcgccctcttcctccgccgcctccctcccgccctccaggcaactccccaactccatcttcctgccgcctctgcaccgcccctttaagcggaacaggaggccaacgcgcggctctgcgcaggcgcctgtgtcatggcgctcccgcatcaaccgcccggcggggaaatgcgctgctctcggaaaactggtgcagctgcgccgcaagggagccgccggggcggtgggtgcgaagcgcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaaggtatgggaaaggtaggggagaagccgtggcttctaatgaaggaaaagaaagcaccgtgcttggtgccgttgtgagctttgaataattatctcttgttaggttgtgttctagtacgcctgtaaattcaccttagtaataatgattattactttaatggagcccctaaatatgctgggtcgaacgcgtaagttctctatctaaacatagataagtatggttatgactcgtggagacagttccaaggctgggagggactttggagtttgatccttcaaccaacaaacgtctgcattgctccagagaagagtaagagaaacctctgcatttaaggcacattacagtctaattctctaggctctagaagattagaagataaataattgcaataaggtacaaaagccaagtgcttggtagagtggtgaacgaaggg

SEQ ID NO: 14966 - DNA, 1181 bp, Homo sapiens
tcaattccttatagttgttatattgtcattttagagtcaaataaattgtaaatatggataggacaatatacagacaccaagtgatatttcatctaagaagttaaggagattaaatgaaagctggaggaaatctttcaccagccccaaataaatgtgaagtgggaaatgtaaagggaaaaaaggggaggcaagaaaacctcttctcacatatttgggaaaagaaacttgtgtgggtaaggaatgggtaaaatagaacctggttaggaccagccattcacatttgatagtacagaaagcttaccaatactaccgttaaaactatttttaggagtaaaataagttacataggaacactgttgtgagatgcacacaactttccctttgaaaaattatctgctgttaactatattcattttctttcaaggtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtga

SEQ ID NO: 14967 - DNA, 1868 bp, Homo sapiens
tagtctctggtttacttccctaactttttatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcc

SEQ ID NO: 14968 - DNA, 1170 bp, Homo sapiens
aggagcattggactgagtgtatgtgactctctgtaagataaaaattaaaattagagccaggcacagtgacttagcctgtaatcccagcacttcgggaggctgaggtgggtggatcacctgaggtcaggagttcgagaccagcctggctgacgtggtgaaaccccgtctctattaaaaatacaaaaaatattagcggggcatggtggcacacacttgtaatcccagccattcgggaggctaagtcacgagaatcgcttgaacctggtaggcggaatttgcagtaagcggagattgcaccattgcactccagtgtgggccacagagagggactctgtctccaaaaataaaaaattacatcatgagctattcagattataaactattatgtttacttcctaagatataaaatgatatatggtagatcttttgtacttataaaatgtttttataggggaaccctataatttgtgacatggcttgatgtagctgtttctttaaaagtaaacttttttttttttaatcattttataggatgtaattggctgtactcaggagatggatttcattctttggcctcggaatgatattgaaaaaatcgtctgtctcctgttttctaggtggaaagaatctgatgagccttttaggcctgttcaggtattttggtctaaagtgtgatgagtatttcaatatgtgaaaactactagaatataatagggtctaacttgagaaattctttgggaaaatggtttctgatagttttatttcacgagtctcccctatttagaatattgtgatgcaagagaagaaagcgtttggattatagaatctcttgacagtgtggtggttccacctgcccagtgtggctttgaaattatgactagagaaaatcttttaaagtggacatttactgatttatagaggggcccacagatgagcttctgagatctgtaactcttgaagccttcaccacacatccttctaaaaccgtatatttaactgctgcttcccaaaggaatgtgatctgaaatgggtgaagaaatcattttgtagaagttgatctgtatataaaattatagaagaaagaagtaaatttagtagtcattcttaaccttaaaatcttgctgacttttgactgtttgtcatggtatactagacattgctcaagtgaat

SEQ ID NO: 14969 - DNA, 1128 bp, Homo sapiens
tgagactccatctcaaaaaaaaaaaagaaaaaccagaaatattgatggttttgataatgtaatattgagaaagtaatggaaattggcccatataaggaataaaactattcatttgtctgaatagcgttgttttaaaactggtgagatttttaattttaagaagtattgtccaaaatagtgctatggataccattatgctataaaactcaagcattaaacattctaatgacagtttgtacatgtatggttggagggggaggtaggggaagaacagaaggaattacctatctgaaaatgtgttttcagtgtataagttactgcagacagttaagaattttgtggagttaatgttacatgacattgtaatatgaactgagtgttaaaaggctgtgctccctgtgggttaatacaccattttcttttcttctagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggtaagttctgccttaagtcttgacttgataaagtttctgtggattaaccttgcatttccccgccccccgaaccccccttaaagtggatagttatgatagtgaccagtctcttcaggtaaatttgtctttgtgccatgttgataactgggatcatgactttaaagcattgtgtttataggattagaaaaacacgtttttttacgccagaccattcttatgtggatgaagtatataaagggatttctttaatctgtgttaggtgttgatgatctcggacttttttttttttttttttttttgagacaaagtcttgctctttcgctgaggctagagtgcagtggcatgatcttggctcactgcaacctctgccctcgcgcattcaaatgattctcctgccttagcctcccgagtagctgggactacagttgtgcgccaccatgcctggctaattttttgtgtttttagtagagatggggttttgccatgttggctaggctggtctggaactcctgacctcaagt

SEQ ID NO: 14970 - DNA, 1235 bp, Homo sapiens
atatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaaggtaatttaaagttcttaatggtgaattagcacaagtaatttttgtaagtgtatattatttgttactcttaaattattatgaatattaggttaaagagtggttgaaaaaaagtctgctttgtatgctctgttttttcacccttaggggtgattctgtgaattgagcagttgcagcatgcgaaaagacccttgagcgttctttggtttggaaataaatttgagtctgaagcttagtagtagtatacactgagttgacatggggtgggcaagattacaaaattttatatggagttaacatgggaaaccttatgatggaatttaaagattatctaatgtagagtataaataagatggttgaaagtgtgaaattgtaatcagactgtttatatgctaaagtttatcctgtttcttaaactgcgtaatgtaggtaaccttttctcttacatttaatgaagtagaatacaccttttaggagcaattaaatactgaaatggttaatttgtgtttagaagtgtgattttcttttttacttagagtt

SEQ ID NO: 14971 - DNA, 1550 bp, Homo sapiens
actagaaacagagaaaatagctttccaagtcatcaaagaaaacccatggtgagaaggatattaatggattaaaacaggcataaagaggaaactgaaggcaaagcattggcaaaatctagaaatgattatcagcttcagctaagtccgatactcaccagctccaaggacagagtagggaagcatcagttacaagttaggagaaacagcactgcagtattgtcggggagcaaggtgagggctttccttcctctttgagggtcagttgtcagtctggggccacactgcttccagaagggcacagaactggaaacctttaacaatggttaaaaaatctgactgctcttgttctgtcgcctgccactgctgcctgagcccgagtggttcactgcaccctgaagacagattccagacgctgggaactcgcgcctccaatcccagacactatgtccagcaaaggctccatgagagttctggcctatggtggcggcctggacacctcctgcatcctcgtgtgggtgaaggaacaaggctatgatgtcattgcctacctggccaacactggccagaaggaagacttcgaggaagccaggaagaaggcactgaaacttggggccaaaaaggtgttcattgaggatgtcatcagggagtttgtggaagagttcatctggccggccatccagtccagcacactgtatgaggaccgctacctcctgggcacctttctcgccaggccctgcattgccagcaaacaagtggaaatcgcccagcaggagggggtgtcccgcggcgccaccggtaaggggaatatcaggtccggtttgagctcacctggtactcgctggtcccccagataaagggcactgctccctggaggatgcccgagttctacaaccggttcaagggccgtaatgacctgatggaatacgcaaagcagcacgggattcctatcccggtcactcccaagaacccgtggaacatggacgagaacctcatgcacatcagctacgaggctggaatcctggagaaccccaagaaccaagtgcctccaggtctctacacgaagacctaggaaccggtcaaagcccccaacacccctgacatcctcgagatcgagttaaaaaaggggtccccgtgaaggtgaccaacgtcaacgatggctccacccacccgacctccttggagttcttcatgtacctgaacgaagtcgcggacaaacacggtgtgggctgtactgacatcgtggagaaccgcttcactggaatgaagtcccgaggtatctatgagaccccagcaggcaccatcctttaccacactcatttagacatcaaggccttcaccatggactgggaggtgtgcaaaatcaaacaaggcctgggcttgaaatttgctgagctggtgtacaccgctttctggcatagccctgagtgtgaatttgtccgccactgcatcgccaagtcctaggggcaagtgggagggaaagcgcaggtgtccgtcctcaagggccgggtgtacatccttggctgggagtccccactctctccctacaacga

SEQ ID NO: 14972 - DNA, 1402 bp, Homo sapiens
ccccctctcaacctactccctaaaaaagagctgctttttgagagagaagcggtaccctctgatgttactgggcggcagtctgcctacaatttccttcacaatgaggcaaccagagcggctttttctgtgtgtttgcttgcgttgaggggagcaggaccataggccctagaggcccccagctgccttctgagactgggcgaaaccctcggcagcgcgcagggggcgctagggcgcgaggggcgggcactgacgggcaccaatcacggcgcagtcccaccctataaataggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccacctacgcatttcaggaaaagagctgtagtacacagatgaaatcccccaagcaaatgcaacacgccctcaattatattagaatcacttggagagtcgatagaactttaacatagcctcatctagtaagaatttactactcaatctatcaaagatagcaaggtgaattcaaatgcaccgagttaaaatcgagttttaaagtcacctgggtttcggtagccggaagtcccgcgtctcacgactccaagctaattagtcataaccgtattgaaccaaggttgaagcccagtcccaggcttgaggctttttattatacaaggttaaagtggggatattgcgtttt

SEQ ID NO: 14973 - DNA, 1374 bp, Homo sapiens
ggcgcgacggcgagcgcttgtaatcccagctacactctgaaggctgaggcaggagaaacacttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcatctccccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatcagaactgatgagctaatatttcctgaggcaagccagggagccggaggggaagctaagaagcttattgagaaaaaacaaaaaccctgttttaggaaaaaaaaaaaccatcttttagcgattatgaaataaaatcacagagacatttaagtatccctcaatcatgtactgagagcaatactaaatttatcgccaccaatacagttttactctattaaaaagaccctgaaaattgaaaccctattcagactcctggaat

SEQ ID NO: 14974 - DNA, 1327 bp, Homo sapiens
gctagtgcaaggtttgtacagaattctcttggcctcagcctcctatccttgagaagaatgttgctttttttaaactacagtgagaacatctttcatatgagaatttcacctactgcttctaagaaacaggtcagctttcaagaaaacataaggccagagtgatcttttcacgcctgctcttttaagtacctttgaatagtcaatatgtcttcaagcacttgaaagacttaaaaagtttaccactccggcatattagtgaaagcccttaatataagcccttattaaaattctcagtcgagggtataaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccc

SEQ ID NO: 14975 - DNA, 1259 bp, Homo sapiens
gaagaagtttgcacttatgaggttttaatttgcaattatttggctacctttttgccttcccaaaacatagggtctttaggagtgaaacttcatagccaaacttataccttgtccagcacagagaaggccatcaaaatgcctggtttaaataaaaatattaaaatgattgggagggtaaatcccttgacctataaatctgacctcctttaaacattatttgtatgttccccaataaactattccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccacttggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacatcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaa

SEQ ID NO: 14976 - DNA, 1413 bp, Homo sapiens
aggcaggactctccgaggagcctgtgttacttccctcacttaagtgcagatttgtaataaaaatcttaatgccagtggcatgctttttggatatataagaagctaaccacttggagtatcatatttgagaggtcagaaaagtccacagttaaagatcggtttataatttacgaagaaaatagaaagttttgtttctctgagttgaaatttgccaagcacggcgggaaatattgcaagtttttggcacaaggctttgtgcttcccttataatttgagatctgcgtgaagcctgagggttcggggatcattatctgagaaaaaccgggcagttcggtgtagacaatttttatatttttggctttttttgaggtgtaacaaacacaactcgggatccgagaggacactctgcggctgccagcgaggcgggctggacagcgcaccaatcacggcgcagctccgccctatataaacgggcgggcgcagcgccgcggctcgagtcccggccagtgcctctgcttccggctcgaattgctctcgctcacgcttgccttcaacatgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaagaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtagaaagttcctttggccaactgcttagaagcccaacacaacccaaaggctcttttcagagccacccaccgctctcagtaaaagagctgttgcactattagggggcgtggctcgggaaaacgctgctaagcaggggcgggtctcccgggaacaaagtcggggagaggagtgggattttgtgtgtctccggagctatttttg

SEQ ID NO: 14977 - DNA, 1105 bp, Homo sapiens
ttgcctaccctttattttcacgatgtgtttgtgcattctgtaaaaagtgggaaacactgttctccggattgtgtgggtgatcgccggtcgcctagcttgccgttcttcaggtatctcctgctgctccagaatctacatctgaatgtcaaggcatagcttttccaggagcttttaaaccgacctttcaattcgaagacgtaactgcgccaggagctttgtctccctggcatataaaagcatagaagagagcaacttctggtttttaaaataagtaaactaatctgaattgtttgcaatggtaggaacttgttatataaaatgttaattaggtggcccgtgctcgaaaactgctctcaggatatgaccaatgggagagtagacctaagctccttcatttgcatgcagacttcacgacaaaataacgaatcagagttggagaaactaaatcttcatttacataacattgtctacaaattccgaggatcaggagatgtagatttcattttctttcctaactgcagaacagcaaagatagcatgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagccactcaccttttcacaattggagctatatactgacatgtgaagatactagaaactcctgcagctgaaataggcatgtttttaaaacttaaaatggcactcactgtctgggctggtggctttatgaaactctggtttccgt

SEQ ID NO: 14978 - DNA, 1180 bp, Homo sapiens
ggctagctgcaggtggcgcgggatgatgcgggtcttcttattgtcgcgagccgcgttgccagctagctctaagatctcggccgtcagatattccagcaccgctgccaggtacactggagcgccggccccgactcgttcggagtagttgcctttgcggaggaggcggtgcacacggccaactggaaactgaagaccggccctggaagaacgcgttttagcttttgcccgagctttgccgccttgctttccacgtccagacatagtggcttcctaacagcagaagaactaacaatccactgaataaagaaaaagaatgggctcgatggaggaataagaagctagttatagtcatcggtagaattgtgaaaggcgcaatttgattggttaaaattgttctttgacgagccaaccaattagaaaggaaataaggtgaaggctattttacatgtatgcgtcactaacacattgcccaatcagagctggatattttgaattctttatttgcatgaaaggcctataaaaggagagactctagacacgagcttttatttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatat

SEQ ID NO: 14979 - DNA, 1105 bp, Homo sapiens
tgcgttcgaagatgtcgttaacgaaggaattcatgatgcccatggccttggatgagatgccagtatcggggtgaacctgttttagcaccttgtacacatacacggagtagctctccttacgactgcgcttgcgcttcttgccatccttcttctgcgccttggtcacagccttcttggaacccttcttcggagcaggagctgacttagctggttcaggcatgctgtcagaaaacaataacagcagtgagaatgaacgcacttaaataaaagctcgtgtctagagtctctccttttataggcctttcatgcaaataaagaattcaaaatatccagctctgattgggcaatgtgttagtgacgcatacatgtaaaatagccttcaccttatttcctttctaattggttggctcgtcaaagaacaattttaaccaatcaaattgcgcctttcacaattctaccgatgactataactagcttcttattcctccatcgagcccattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctcaatgttcactgtcctaatttttaacgaacgcttctgacgttactg

SEQ ID NO: 14980 - DNA, 1213 bp, Homo sapiens
tctaaactaatcacccctcttgtacatagaactttctacctcagtgccaattcctagaggttgatgcaaacagctcgccagagagcctgtgctattgttcctgcgaaaaaacccaatttccctgcacatttggataaaaatgagtttatctatataaagttgagacggtaagaattcacagaacaatgccctggaagagagatttgcaaatgaaagagggagaaatagtatttttaaggaaaacatgaaagttgtctcgatttgaccgaagtttgaaagagagttgggggaataagaaaagtttcaagatgccggttttaaaactatgcatagaaacaaaggcaggaatgaagcccgaactctctcggatcagtttcccccaagtctctaattatttcatgcccagatttcttatatttttactcttttttaaggggcaacaaacacagcagcgcggtagatacgaggagtccttttccagcagcgccgcgcatggagcaaggaaccaatcatcactcagcgtctctctatataaaccctcagcctccctcgtagaggacatgctgttctgacagtttgagattacttattgtcttttctgggaagacaaaaacatgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggc

SEQ ID NO: 14981 - DNA, 1134 bp, Homo sapiens
acccaaacaaggaaacaggaaggagtcaaatcaacttgcatttcccctaccctcaccgccccctttccttcccaaggcaatagtgtaggggacgcccagtaagttacggaaaaggcggagacagaggtttcgttcccgcccctccaattcagtctccaaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgctcttgtccaggctgtagtgcaatgacgcaatctcggctcaccgcaaccaccccctcccgggtttaagcggttctcctgactcaacctcccgagtaactggggttacaggcatgcgccaccacgcttggctaattttttatttttagtacagaaggggcttttctgtgttggtctggctggtctcg

SEQ ID NO: 14982 - DNA, 1160 bp, Homo sapiens
aaaatatttcttcaaagtaagagttttttaaaaaatataaaggagacattgagctggaccaatcactctcaaacgcggtatttttgaatcgctccggaactgcagaacgttcatttccgtctgtcaaacataatcccaaacaaactgattaaaataaaatcaatgaaggtacgtaatacaggtaggcacataaaacataataaaatgtaaggaactaggggaaaaaagcatttagataggttaagattttctaaaatgagacctagtagctgatcacaagtcctatcacactacataattcagggcgcgaaactggaagattcggaccaatcagaaggactttgcctttataaataggagtaagaacaactgtttgttcagttgtgaccattgcttgaaacccattcctatggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataagttgtactgagggtgtgcgccaacttaaaccaaaggctcttttcagagccaccaacaatttcagttgaaagcgccgtagcactagggagtaatgtctcctaaaacaaggagggtggagggttaggggatgggggcagggccggtggctcttctaaactaggcttttgtgtcttggccattgtcttcaaaatggccgatagtggcggctcacgccttgtaatcccagtactgtgggagcccgaggagggcgggttacttatacaaaggtcaggaattcgagactagtctgcctaacatagtgaaaacccgtcttcactaaaagtacaaaaccaaaaaacaa

SEQ ID NO: 14983 - DNA, 1186 bp, Homo sapiens
aatggtataattctggaaacacgtaaatctttagctaatttccattttagaattagttattcatagataattttaaatccggaagctgcaatttggtaggaaactagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagtacaccagctccaaataaatggacgcatgttcaaacccaaaggctcttttcagagccacttaatgatttcaattaagagttttaatgctgggtgctgctgtattctatgggagaagtgtcgccaatacaggtaaaattttcctacatcacctgtttattctgtgcgtttgacaaacactaagcttttagagtttatttgtctttataaaggtggggtacaactacattgttcaggctggtcttaaactcaagcgctggtcttaaactcaagcaagttttcccacctcggccttgccttgtattactgagcagataatttgacacagcaggaaaagtgggcattcttgtttaggaaccaaaaactaagtttgcaacttaaaa

SEQ ID NO: 14984 - DNA, 1150 bp, Homo sapiens
gacaaaatagaattcagttaacatttgttgctcactgttgtatgtcggtgacttcttggctcgtgatttcccaggtacatcacccaggaatcctgccttataatggtcaaaggtttccagctagcagcagtccaggtgactcaagaaaacggcacaagataaacttctcaaaacgtggtcctccgaatctggccccacaacacatctactgaatgagaattagcgtcttccaagtcttaaagtagtcgtttacggactacagcttgagaagcgcagaattagaactttaagaagttaacgttcttggatcgcagactaaccgagaagagaggattcaaaaatgaagtgattcatccaatcagattttccagtaattcaccaatcacatcgttggactcttcagccaatggttttgttgcgcgggtcttttgaaaatcaacaaggccaattagaatgtttctgagtatatataagggcagtttccactctgccaagtggctgagtttttctttcaggtagtctgagatggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtagaggtttccgggcagtaattctatccaacttaaaaaggctcttttaagagccgcctactttcacccgaaaatagctgtgattaactaatcaaatctttgaaactaaacattggttttagtacttaagtcctcatttgattggctaaagttaatggtaagcttgctatatttgttcccgtgctttttcccgaaagtgccagattgtcagcgtcctt

SEQ ID NO: 14985 - DNA, 1157 bp, Homo sapiens
agcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaac

SEQ ID NO: 14986 - DNA, 1139 bp, Homo sapiens
agtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttgga

SEQ ID NO: 14987 - DNA, 1359 bp, Homo sapiens
aaatgaaaataagtagaaaagaacttagcaatatacctgaacgatctttaaattctatgagtctatcttgttctattgctaggaatttagcatatggagtatatttccattgtatattaaggagaaaaatgccacaaaatagcatagttccatacaaataatgttaaaggaaaacatgcatatatgcagagataacattctttttgctttatgtatcttctataatgttaacatttttgttatgaggcaggaatcatgttaaatgaaaaaaggaaaaacagcctaggtcttgaggattaaaaaggactgaaggagaacaagagggagtagagcacagcaggcctgtttcccttttaggtcccctcccccaatgcagagggacttcccgccaaagctcttccggttttcagtctggtccgcagaggttacccataaaagaaagctgccatcacaggcagcagacctttgttctctgaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatggacgtggtctacgcgctcaagcgccagggccgcaccctctatggcttcggcggctaaatggcattttgaagcccagtcattctctaaaaaggccctttttagggcccctaagctttcaacaaaagagttgaaatgactgcaaactgagtctcttaatagggccattgtcagtgagttctgtcatcctattttacaagattaactcgacgccgaaaatgggctgatgactacaggtgaccttgggccgagatttttccaaggccagaagagcctctgctggccagtaacttctggcggctgcctggaaattgcctgcagccggtttaccgctcggattagtttagaaagccaaggggtctgcggtccaaataggggcgggctagataattaacttccctctggaccttcaaatacgtctcaggagataatgagtttgatgggctccactaaatgctagaacctccaggaaaacttcgtggtggctggtttaagaggacttggcgggcacagagctctgcatgggggggagggggacagaccatgcttttactactgtagaacagtagggcagtcttaagagtcttagtaataatattcctttatatgtttgccttttaa

SEQ ID NO: 14988 - DNA, 1874 bp, Homo sapiens
cagtgggcacacagctccaagagcttggagggacccttctcagttgtgagattatgaactcaaagttcaagatcccaaagttttgttgtagtgtgaatggcaagaacagtctttctctgatgcttctagaagattcaaatcataaaaagctttctttgcctgttgaaaatacactgtagtaatctactgttataacatcagccctcttgcataggaaaccttttatacaaccagaaaacatgcactgaaaataacaaatgagctctcaagcttggtgtttgcttggtggggacccacgtgggttcaacatgtgtattgagaagtgttatttctgttcagggcccatctaccctggtcacggcatgatgttcgtccacaacaattgcaagttgttcagattttgtaaatctaaatgtcataaaaacttttaaaagaagtgcagtcctcgcaaagctaggtggatcaaagcattccagaatgcagctggtaaagagcttacagtggataattcatttgaatttgaaaaacgtagaaatgaacctatcaaataccagcgagagctatggaataaaactattgatgcaatgaagcaaattgaagaaatcaaacagaaatgccaagctaaatttataatgaacagactgaataaaaataaagagctacagaaagttcaggatatcaaagaagtcaagcaaaacatccatcttattcaagcccctcttgcaggcaaagagaagcagctggaagagaaaatggtacagcagttacaagagcatgtaggcatggaaaacacatcttaaaaatctctgtaaccatttcttttatgtacatttgaaaatgtcctttacagacttggaactgctaaattattagtttattttttacataaggtcacttaaatgaaaagtgattaaaacatatctttcctacattgacatctgcaaaacatcagatattacgaatgttagattgcatctcagtgttaaatcttcactgatagatgtacgtatgtaaatcatgaaaattctacttctaactatagaagtgaattgtggatgtaaaatggttatgctatttggataatggcactaggcagcatttgtataacaactaatggcaaaaattcatggctagtgatgtataaaataaaatattctttgcaataaaatattccgtttattaacgttacagaaggggggatacaacaaggaactaacaatttgtataacagtgtcaaatgttattttgattttagtatttcctgttttggtttatttgtatcttagaagagcacaatgacattgtttgatgaagcctaattattctggactgttttgacctggtttaacccttctgataggtagttgtggatattggggatgagaactgaataatctttgcctggagtgacactacactctagaatttccattttggagaatactcagttctaacttgtgactgctggtagaacaaactttatttttctagcctagcaatgttctagaagcagaggaatcccagtgccttttaaaagttattatatggttttcttttaaaaagctcctgtttttggaaagtagaatttatgagtataacatctgttcattatttgcacataaaatgaaaccatttaaaaagaaaaaataaacagaaaaagaaaataacaaatgaataaaattcctttataaaatgtttaaatgggcgaccacgtgaccaaacatatctgaagctttgttttcccaggaatatggcatcaagcattggttataaactattttaaacaatttcagtattagctggtttaacatgaaattattttcttgatatttaattaagtttttgttttacttgggttagtagctttatacaag

SEQ ID NO: 14989 - DNA, 1179 bp, Homo sapiens
gtcctttcttgtatttcccacagtattgatgtatatcttctgcgttcaaaagcaattttttaaagcctcataacgtggtaacaaaatactatgcacgttacaaaattcagaacacggaaacaagaagctcgctttttttttccccctatttcggtttggccctttagatttcccctcccccaccggggcgggacttcccgccgacttctttcaggttctcagttcggtccgccaactgtcgtataaaggcgctgcctcaggccagagtcctcacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaacaaaaggccctttttagggcccccactttctcagctgaggagccgtgatgcttgtttgcccagtttctctttaccatttgttcgcgcctgctgagtttgtgctgctatcggagcatgcgtctctagtcgctgtaagtaggcatcagtcactaatcgctctccagtaaataaaatacccaacacaacttgtttcaggtgctccagagcttactgacatgggccgtcgcgcagactgtagtgcagtgtcatcatggctcactgtagcctcccgattagccggaacctcgcgcccaccaccacgcaaggctaattatttttccaaagaccgggtctccgtgtgtttcccaggctagtttcgatatcctggcctcaatcccctcgcctatgcctaatgttggtattacagtagtgagccaccacgcctggccacgatactgttgaggttttagggttagttacatttaaggggcaattttcgcagtgtagtggggaggaaagtcaagcagttataggtttctggcgctgtgaatccaactgctgaacat

SEQ ID NO: 14990 - DNA, 1074 bp, Homo sapiens
gagagggagaccctgtcttaaaaaaacaaaaaaagaagaagaagaaaaagctgtgtgttgtaacgtcctgttcacgaattcttatgcaaatgaggtgattaataaaatagtgtgtaggactggtggcgattctagatgacgtcatatacacgtttgtccaatccaaagaagcatgtttcataacagcgattccattggttgaaataaaactgtaatttgagccaatggcacagctttattttcgcgcccagtattgactataagtagtggagctctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataatgtctccatagaatcactttccaatacaacggctcttttcagagccacctactatttctgcgggagagctgggccactggttaaacatttggaacgtttgttatgaaaagataaagcatttttcatctagagcttaggaatgacttttaggaaaaaccttacaggattcaggtgacatgtttaagtcagaatgtgaactagttatttaatgtagggcttacaagaatgttcgctgtgtttattcatctcgtgttatatgaactagaaccaataaaaaaaaatccagagccaggctcagtggctcacgcctgtaatcccagcacttttggaagctgaggcgggaagatcgctgga

SEQ ID NO: 14991 - DNA, 1180 bp, Homo sapiens
ggggcccgagcatagcagcaacgcaaaacctgctctttagatttcgagcttattctcttctagcagtttcttgccaccatgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtaggaagctggcgtgtgaaaaccgcaacaaagccccaaaggctcttttcagagccacccagagacctctaaaaaatggctgtgcacaacatgttagatcaggcagcaagattccttgcattcgaaaaatctcgggcagttctccctcaaccctaatcgagtaacgcaaggcaagcaagagtccagggtgttggttggactccccacgtagtttacccatgcagtctgttattagagtatgaattccagccgttggtttttgttaagttggtgtcaagctttttgtcagacgcctagctacaaagaagcttcttatattttaaaaagcccgctctataatctgattggccagtttttgttccatcatctgtatgtggtttttccgcgtttaagccatttaggcaccagctacttcggcgtcacta

SEQ ID NO: 14992 - DNA, 1144 bp, Homo sapiens
atggaatgcagcggtggtcagcctaaaacactgtagaagggcaagatgagctgagtaatttttaactgggcatcatttttagaaactggagtttaagtacccccttttccattttttcctgaagtcgtgggcagggcgcaaggtctgtgaatcggccgaccggatgcagctggtgtggagagttcccaatcaggtccgatttattactatataaagtactgctgcgaggcttgccgtgttgcattttgtttagtacaagacatgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctgagtgttttacttacttacacggttcctcaaaggcccttctcagggccacccatgaagtctgtgaaagagctgtagactaaagatagttaatttcttaagaacacttaaacgtatggcagttttggcaaattagcgattccacataagcagtcgctgaagtttgaggttcggtgcccctttcagcattacttagtggttaaaagtgccggcttctctgatacacggccaaatctataacgcctctctggtttttgcaaaagtcataatgaaacagccggtctcatttatcttgtatcgattactttaccgctaccaatgcgagggctgtgtaactatgacactgtggtccgcaacgcccaaaatgttttaatatcgccctttacagaaaaagtcggccaacttctaaaacattaagtacgtttaaatttgagaaatactggcataccacaacgctcgaatttcatatccccttcaatgcctccatttacaaatttactctagtttcacttttcctttacgttctttaactttttgtcaaatcagtaatgacacctcgtaattaaaatagtgca

SEQ ID NO: 14993 - DNA, 1129 bp, Homo sapiens
attagaagccgtcaggtaaaaaaaaaaaaaaaaaaaaaaaagtggcaggaaccaaatgaagatagtattaacaaccaaccaggtttttcctacaacagttctgaccaatcaggatcagatcatcgttataaattctggtagaagccactgctcattcagctgcttgctttcagagcatagctttctcaactatggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccacttacattctcactgaggatagctgtcacaccattggtcgactgtcttaaatcaactttaaagcagggataaactggcggaaagtcgtcaagggttgttcattctgattccttgcagtgtcctttgtcttctaagacggtccttttcacttgtcctctgtgacccatctcacaagggtctcactttctccgaggaaagtcagcaaatctatatccaaggtcaatccgcttcaaggggaaagccaaagtccttcctgcacatgctgtcctttggggatagcatctccagaaccccataactaacaattagattacaggttaaatgagatgccatttttaactgaaacgggcactgcccttgggtcccctggaagcttgctgaaaatcacggacatgaggccggttgatttagcacatagacacgggagacttcaaaatgaggacccacccaccaatgagatacag

SEQ ID NO: 14994 - DNA, 1183 bp, Homo sapiens
atcacctgagcccaggagtttggggttacaatgaactatgaccacaccactgcgctccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctacagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctcca

SEQ ID NO: 14995 - DNA, 1102 bp, Homo sapiens
aattggaggtgaaggaatagtggggatatggcaagggaggggaattaaaaatggaagtgataaaggtaggaacatgactatggaggcgaagacttaaagtagaaaaaaatataaaatatacttgatgcctataatttttcgcataaagatacctccctttactacatttcagtcgctgtctcttgcacacatacatgcacacacacagacatgtggctttcatccattcccacaatgtaatgggtgtgaagaaggcagaggggcagggaactcaaactttctgataaaagcacatagaatctcctctcttttaaagcacattaagcagctctccctcagctttgtgtgagccccatttccttccccagcaatctcctgaatgccctggttacctccttgttcctcagggtgtatatgagagggttaagtgaaggagtgcccactgcatagaagagaccaaagaacttgcccctctcttgggcatagggatttttgggctggaggtagacagcaatgactgagctgtagaagagggtgaccacagtgagatgggaggagcaggtcccaaaagctttcctccgcccttttgcagagttaatcctcagcactgcccaggtaatggctccgtaagagacaaggatgaggctgagaggcacaaccaagatgaagacactggcaacagccacctggatctcattgtaggaggtgtcttcacaggagagtcgaattagagctgggacctcacagacaaaatcatccacctgccgatcggggcagaagggcaggtgcagggtggatggtgtctggaccactgactccactagcccaatgacccaggccacagatgccagctgccagcacaggcgggggtggatgatggtggcatagtggaggggctggcagacagccacgtagcgatcaaaagccatcactgtcaagaggatgcactcagttgtccccagggacaggaagatgaagatctggacagagcagtccaggaagctgatggtcttctttgggccccagaggttgaccagcatttggggaacacaactcgtggtgaaacagaggtccaagaaggagaggttggagaggaaaaagt

SEQ ID NO: 14996 - DNA, 2226 bp, Homo sapiens
tgagcctctagtagtcaacactcacagcagctgggtgtagcatgcagccccagcataaaggacctgggcaggcgttcactgtgccccaggctgtcattaggggctggtgcaatgccaaagagagggatgttccaactgggttgacacatctctctgatttattggaagctctgtgcactgacttttctctccttccccactttttccttttgtttttaaattctctcttatttccctgatcgcattttttctatcggtatccttatgttctctggcttttcttgttctgttttgatttctccttttaatttattctgtccacttaccctacgtcctccccctacatttttctgtgcccttcctctctttccctgtgcccttcctctctttccctcctccccactccttcatcacctcctcttctcctactatcccaattgtgcttcttcctccagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaccttgcagtcttcctgtgaacagaatgggcttcaatccaagaagggaggttcagaggactccaagttcatgaaaaggcattaaagcggagggtgaaaagaggtgttttattgatccattgagggcttagcagaatgaagcaggacatgattaagtctgagattagtgagtgaggacactactggttaaaagtgtgggctctggagtcagactgccagggtatcagatccaaccacatgcaaacattttcttagtctctattccccatgtcctcatttatgaa

SEQ ID NO: 14997 - DNA, 1120 bp, Homo sapiens
gtttctcttctgacgttttccttgtctgcctctctgagatactgatcatgttcctggacaggatgagaataaaacctgtgtaactcccatggccatgtatcatggagtttttcattctgacttgttgagaatgaaaacagggaaaccagatataacccccactcctactccaaagtagctaacgggaggaaaaaagaaaagaagagaaaaaaacaacctttggggccaggtctcacagtcttggactctacataaatagcctgtattctagtgggggcctgtgcttgggaagccctctgcaactccatcttcagccccatgactgcattgctctgcctctcaaggctccactgtcttctccaatcctgtcttcctttagcccctggccctgaaattagggtcatgccattgcgtggtatttggagagctcagcctccctggagaagaggggtaattctctctccctctcaccctctccacctctgccctagttatatccagaactcacagcccaacctgaacaacctgactgctgtgggctgctcactggctttagctgctgtcttccccctggggctcgatggttaccacattgggaggaaccagtttcctttcgtctgccaggtgaggaggtggtgggcaaattccttacaggatgtgactctcccacccgtctcaggagcaccttccatgatttatgattctctgcccttcctcctcagctttccctgactcttgtccctgttctttccttctagcatcacccctctgttctctgtttggctctgtcccttctttctgtgtctgcaggccattttcattctgtagtttacttgtcagttccaaggttgccatggcaggccttgcagagaagaggagggagccattgaaggcaaaggaaggggatctgctcaaaggtctcctgaacaatggtggcttgtctgtggtatgggggctgagaatcagaactgtggactttttttgggagcctttgttgggtttggaaggatagaagcagagatggaaacacagcagagagttggggggaagggaccactgccacacagggaggaggggctctgggactgttggtacatggaaggttctagtgctgtgggga

SEQ ID NO: 14998 - DNA, 1171 bp, Homo sapiens
caccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctgtgagttaaaacttccttcatactcccctgtcttcccaatcttgagagagactcccaagaggcaccttctacaaacatgcattctctgtttttctcagttacttctttgcagaatcagtctccgaccagagaagtagggaccttcaaattagaagaacccatcaaagactagaggaaaaaaaatgatgtattccatttttttaaacccctcccctcatttcttttcaaactagaccaagtattcatgagtcagatgagaactataggattttgaaagacaaaacagtctgaaaggtcatcttcttattccttttaaaatgaaaagattagtttccagagagatttgctgacttgcttaggccacacaaccagaagcctgctggtgttctgtctggggattttttcccattcaaatctcataagtgaagctccttctccaaagaataatgtttctaaaatctagggtatgggcatctggggtatgtcctatatgcaggcaaatgccataaatagcattcattcagaggctcaattacatcaaaaacagaaggatttaaagagtccctgatgttctctttcactcttgcttttgtctcctttgccttgctccacatgttccttccctcagggccatgtggtgtttgatgccagcggctctcggatggcatggacgcttatcgagcagcttcagggttagtacaggggcaggaggggaccggacatgggggctaggctggggctgggctgggatgccccctggggaagaatgccagagacatcacaagattgccctggcacctcccaacttctgcccttctcttttaactctgttcatcaagcttgtaaataataataataataagcttaactacaagaagattgatgtctttgagttgcactggttttgctcttgaaaagaggtgtgcaggctgggtgtggtggctcacccctgtaatcccagcacttttgggag

SEQ ID NO: 14999 - DNA, 1205 bp, Homo sapiens
tggagttggatctgaagagggaggggcactgggtgggagtttcccttggttttcttgtggggcctcctcttggcatctgtgcctgagttgatagcatatgatctgaggtgacgattcataggatgtctctgtctgttggctctgactgcatcccttgtctgcacacacatgatactttcttcagatctcatttttctactgctttgtgtttcctgagaagcccatgaattccatctgtcctgactggctggaaaaggccactcagaaatacaggggctggggagaaacttagaaggaagaattgtcagcctttcctactatccccaagacttgtagatttctctttttagttctactgctcttccctgattcccaagaggctaaatagtatcaagtgagataagacaaaaacaaacaaatgagcaaacaaaaactcagccattctcctctgtattcaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatggtgagagtgtggggacttgcagtctggcacctgggagggtggagaggactgagggggccttgcaggggaaagggtggcagggagagggtgcggaatttggatataaaggagaagagggggctgtgcccaccctgaacttgtctgcattatgtttcctgtggatcctacctttgctctgacttccttgggtagagagagaaaaaaaaaaaaacgatggagttgtatgttcagtaggttcctgatgagtggaagggctgttaccatggagacgaggagcagttggtgagaagtcaggaggaaccggcattaatgataatatggatgcttgtatactcaagcacacctttacaggagcactgtgtctgggcagaattgcatttcattttcttggtgatttatgttagtgttttagagttgcttaatattcactcatgattgatatgcaattagcttggatcctgttgctttttttaatgattctttttttagaattttatgtggagaaggggcttttgaaatcatttagccccagacagctggttaatgacagacttg

SEQ ID NO: 15000 - DNA, 1274 bp, Homo sapiens
tactggtcttgttcctgttctctctttacttatcactagctctgaaaagagaagagggaggaaacaaatggaaggtggggagaaggggtttgcagaggtgaggaaggaattttcataatatggctttgagcaagctatctggggatgtggaaagagtttaccgtattcctactgacttcttccacccactggtgtttgaagcatagaaacatggggtaaagggcttggtgacagagggaagggggatgtctgagggtgagctgaaaggaggtaaggtggtatgttcattaataccaaaggaggggtgtgcaggagaggtgatgggtaaggctccagatggaagacagagaaggaagtttaatgaaagaggagaaaaaaggcacttgacaggaagagatgccagaaaggagaagaaaacggtaattaatgatgaaagtgagtaattgagaaaggaactaatttgttcgagaaagataagagcaggaattgcagacaggggaggggccccaggagagcttgccctcatctcctcttgtctttcagtgtgatccaggccaagccaccaagtacctatatgagctgctctacaacgaccctatcaagatcatccttatgcctggctgcagctctgtctccacgctggtggctgaggctgctaggatgtggaacctcattgtggtaagcagggctatgggggtcagaagatggggtcattcccttttgagctctactgaagggacgatggcgattgtgggtttgtattgaaaaggagtgtggaggacctgctactaagattcagagtcctctgcagacctgagctaggcagcctcctagcaacagtggcctgacagtgctgcagctgacctccttcttcagaaggaattgaaattagatcagtgaaagagcatcccggttgtgaggggtgtgtgggcctttgagaatctcttttccttaggcagaccagaggtggggaggtttggagagagtaaggaagagaaacccaaaggcaggaagagggttaaaggaactcttggccactcttggtgtcctcagtgaacagaccctgttgcactcactctccctgccccacagctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcggtgaggagggg

SEQ ID NO: 15001 - DNA, 2377 bp, Homo sapiens
tcccttttctaggcacccgaactctctgccatcttctctcctgggatgcagtcatcccatttgtatgcctcatacttcctctaccctggtagattctttcaagatccttgggctttactttcctcacataactcagttattctgcttctagtttaccattttattctggaaattgagagtcccatccaggggtggacttatgacactactgaaacttagacttcaaggttcctcacctacagggccctcttcctgtgctctaataatatagagggctcgatggatatgtgttcatatggtaacaggcttttgtaaaaattgcagaaataagattttaacagcaattgcttaaagccaattgtatgtgtaattttttttcttaaagactcccaattttgtaatattcaggcaccacagaaccaagatctgccccaaacttagctattggcattcccgtctcaaattctgttgtcctatgaaaaatcgaagaagaaaataagtcctgacccccttacccccagacccaccttgttcttatccccaggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcaggtgagatgagaaacccttaccgcgcgcactgcaatgccctccccttcactctgcaccctccacccccctgaaattctgcccttaggctacggggcgtcgtcctttcgcaccttccccaacccaccccagtttgcggccacccccttccctccctacctgtttcctgcctccagtcccggttttccacgaggctgcggtctctccttgtccctgcttggctacacttccctgggctccacctcctcccagactgagcctcgccggtgtcaggcagagcccagcagagggcggcagggtgctgggagaccctgagctcccaccacgttttcccctgtggggttccttgcgaccttcgctggaaccttttccagcctgctgcctcctaggatttcacctaatggactttctcagcctgtcccacccatcccaaccctggccaggcctctcgcgctcttccccacatcttttccttccgtgtaccccttccctcgtcttttctcaattccatgtcctgtctccctttcttaggcttctgtctacccagccccaggctcccttccacgaccccaccactccctcaaaccagcctcccttccgtacccaactcgttccctccaaaaccgtttcctctcccccacatcctcagtgcttcactgtatcgactcatactcccacttcagacctcaggcgccagccccgtttctctcccgtcccactcgcatccttcccttcctaccctggttcctccgtgcttcagcctcccgcggctccctccgcccaccccgccctcctggcacgccccgtccccatttctcctcccctcgggtccccttaagtgagatccctcccttcctctttcgttcctttcctcctcgaggttgcatcccccctcccctccccgcccctccgactgtcgctcccacctcggcgctcgcttccctccccgcccccttcctgcctccccagctcccgcccgcccccccaccccccgctgccgcgcgccgcccgtgacgtcagagccccctcccagccccacatctccctcctgctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaaggtagccctggacatgggggtgggtgggaggtgggggcttgcggggcagggggccagccagctgcacgcgcc

SEQ ID NO: 15002 - DNA, 1141 bp, Homo sapiens
aaagccagtttaatattaatagaagccaactataataagaaaagcaaatctgattgtgcatccaaagttatatacatctacatatttcaaagccagagaaccgcccactgtagctgactttgaagagatcccattttgtgtgcttatagccccatcttgggttcctaaaatggtaattttttttttcttttgggaatgtgtggatgcttgcacaggtaagggaggattggaagataggtaggcaaatccttttcacatgtgattttctttagagcaggatgcttgtggacccaaacctgcacctgagtcccctgctctttaaagggaaagagccttcttcaactcgcctctcttcttattttcctatctctccacagtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacactggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagacaggtccttttctgtacttcc

SEQ ID NO: 15003 - DNA, 1112 bp, Homo sapiens
cgtgattcgcccgcctcggcctcccaaagtgctgggattacaggcgtgagccaccgcacccggccaaaactcgtatctttattaattagcacctagcttgtttgtttgtgtctgaccatcaagtagtagttgttgaataaacagtggatactctgatagatatgaagataggagaaaaggatgagaggaaggaaagattctgagacctgtggaagatgtgtaagtagaaggaaaacattctaaagcaggcatgttgcccagctttcgtttttgcttccccaggtccctagtaggctgccaagacaaggaggagctctggctagtattctgtaggtttctccccatctccaggtttgggttggggctactcatatcctcactcttcagctcactcagctctctcttcaatgttttgcactcttcctcttccttcccttcacatgcctttcagttttgcgcaatcagggctggagtcttggaagaaacaaccaccatttgcaaagttaccatactgtaattttcagtgaggagattcctggcctccagttcatggcagagaccatcctgtgttgctctccagtacaggtgtcctctgatggagagaggggcacctgcctgtccttagccagagagggcttccaggtggaagactggagagagaaatggaaagaagggtaataaaaatgggaaaatgaagagaaaaggtagatgacagaagaagggaaatcaattctacttggaattcagagtgttcctgaaagtgcaaattggaatgtccccatagcaaagatgccagtgagtgtgcaacttgatggatgagatgtccccaaggacaaatccctgggcaaccaggctctcctccacccctgccaagatgtgacatcactcagaagggatttcctagaagaaggagaaaataacttgaaaaacgtatgtcagtagtttgtatcataaaaccattgaactagggagaagaaaagcccttggggtcatcttgtctccattcctgcctcaatggttgatctgagaggtgaggcactgggcagttgctgtggaatgggcaatgagaccagctagggttggattcctgcttaggggcagtgaaggaggaa

SEQ ID NO: 15004 - DNA, 1696 bp, Homo sapiens
ctggtttcgaactcctaacctcaggtgatccgctggcctcggcctcccaaagtgctgggattacaggtgtgagccaccatgccaagcctctgttggagttcttacagtgaattttgtgttattcttcctcattcactgtagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaaatacataaaagacaaggggttagaagtgtgcttatgaaaacttgtattattattttttatttatttatttatttatttatttatttatttatttatttatttttgagacagagtcttactctgtcactccggctagagtgcagtggcacgatctcagctcactgcaacctctgcctcctgggttcaag

SEQ ID NO: 15005 - DNA, 1150 bp, Homo sapiens
cgaggtgatctgtgacagatcctagcctggttaccccagctacatgatttccaatggtactgagtctaacattaacattaggtttaaacattaacttttgtagatcaagaatgtccacttgtccttggaaaattatttagcatctctgcattaggtccttaagacagggccagtaattgttacctcattgctgagagcatccagtggcacactgtaggggtttagtaactgctggcattccctgaccaaataaggaagctgtttcttaccctccctcttgctgatatgttttgtttttctctgacctcaggtttctagaagcagggtagaacagacggcagacacctagcccaggctggtgttgttactaaacaatggcagctggtgagccaagggtgaccagggccctgaactcggtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaaggtgaggagactaagctagagagaggtggggtccaggtcctggactccaggagctctttcatacatactcctgcctgcaggtcaaatgaaatctcagattgttccagactgaacgacatccagaaaaaggagctgcaagacctttctccatctcccgcaccatcctggcatccttcatggagtacttcctgaaatttgttagagtggcagcattttttccttcgctttgctttcctgtttatattctgcatatctgcatatcctctttcctctcccccacatcttatctttctccctttctcttcatctttcctttcctttttttttttttcttttttttttttttgagacggag

SEQ ID NO: 15006 - DNA, 1206 bp, Homo sapiens
cgccctccctctggtcttgagggagaagaatcctcctgggtttccagagagtgactctgagggtccgccctgctctctgacacaattaagggatgaaatctgtgaggaaatgaagggaagacaatccctggaatactgatgagtggttccctttgacactggcagcagccttgggccccgtgacttttcctctcaggccttgttctctgcttcacactcaatgtgcgtgggggtctgagtccagctcttctgagtccctcagcctccactcaggtcaggaccagaagtcgctgttccctcttcagggactagaattttccacggaataggagattatcccaggtgcctgtgtccaggctgttgtctgggttctgtgctcccttccccaccccaggcatcctgtccattctcaagatggccacatgcgtgctggaggagtgtcccatgacagatgcaaaatgcctgaattttctgactcttcccgtcagaccccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccgagcccctcaccctgagatggggtaaggagggagatgggggtgtcatgtctcttagggaaagccggagcctctctggagagctttagcagggtcagggtccctcaccttccccccttttcccagagccatcttcccagcccaacgtccccatcgtgggcatcgttgctggcctggttctacttgtagctgtggtcactggagctgtggtcgctgctgtaatgtggaggaagaagagctcaggtaaggaaggggtgaggagtgtggtctgagatttcttgtctcactgagagttccaagccccaggtagaagtgccctgcctggttactgggaagcaccatccacactcatgggcctacccagcctgggccgtgtgtgccagcacttactcttttgtaaagcacctgttacaatgagggacagatttatcaccttgatgactgtggtgatgggacctgatccca

SEQ ID NO: 15007 - DNA, 1183 bp, Homo sapiens
ctcacccaaccccagattcctcctctagccgcatctcctctgggctctgaccaagtcctgtttttgttctaccccaggcagcgaccatgcgcagggttctgatgtgtctctcacggcttgtaaaggtgagacactgggggacctgatgtgggggggtgttgggggcaatagtggacgcagctgtgctatggggtttctttgaattggatgtattgagcatgtgatgggctgtttaaagtgtcacccctcactgtgacggatatgaatttgttcatgaatattttattttatagtgtgagacagctgccttgtgtgggactgagaggcaagatttgttcacgccttccctttgtgacttcaaaaaccctgactctctttctgcaaaggcacctgaatgtgcctgtgttcctgtaggcataatatgaggaggtggggagaccaacccacccccatgtccaccatgaccctcttccctcatgctgacctgtgttccgtctccaataattaatcattcctgctccatagaggtgaggctgagatgtctccatctctgtctcaactttatgtgcactgagctgtaacttcttacttccctattaaaattagaatctgagtataaatttactttttcaaattcttgccatgagaggttgatgggttaattaaaggagaagattcctaaaatttgagagacaaaataaatggaagacatgagaaccttccagagtccacatgtttcttatgctgatttgttgcatgagaggagagtagatggggctgtgcccagtgggtgctcaggccaccgtgcgctttatgtggtcactgctcagctgggtcatctttgctgctctgttgtccttggctgtatgatccgtccctacggggcttagcgggttttctccccgtgtgcggagatgagagattgtaataaataaaagcacaagacaaagagataaagagaaaacagctgggcccgggggaccactgccatcaagatgcggagaccggtagtggccccgaacagctgggctcgctgatatttattgcatacaagacaaagggcagggtaaggaaggtgaatcttctaaatgattgacaaggtgaagcaagtcacgtgattacaggatagggggcccttcccttttaggtagcatatgtcaccattttcttttctgcacttaag

SEQ ID NO: 15008 - DNA, 1206 bp, Homo sapiens
cacatgggcgctgctggggtgtcccatgaggaatgcaaagtgcctgagttttccgactcttcctttcagaccccccccaagacacacgtgacccacccccctctctgaacatgaggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctggagaggaacagagatacacatgccatgtgcagcacaaggggctgcccaagcccctcatcctgagatggggtaaggagagagatgggggcggccatgtctcttagggaaagcaggagcccctctggagacctttagcagggtcggggctgggtcctggaggtcagaaccctcacattcccctcctttcccagagccctctccccagcccaccatccccattgtgggtatcattgctggcctggttctccttggagctgtggtcactggagctgtggtcactgctgtgatgtggaggaagaagagctcaggtggggaaggggtgaggagtcgggtttgagttttcttgtcccactgggggtttcaagctccaggtagaaatgtgttctgcctggttaccgggaagcaccatccacattcatgggcctacccagcctgggccctgtgtgccagcacttactcttttgtaagcacctgtgacaatgaaggacagatttctcaccttgatgattgtagtgatggggatctgaccccagtaatcacaggtcaggggaaggtccctgctgaggacagaccttaggagggcagttggtccaggacccacatctgctttccttgtttttcctgatcctgcccttggtttgcagtcacacatttctggaaacttctcaaggttccaagactaggaggttcctctaggacctcatggccctgctaccttcctggcctctcacaggacgttttcttcccgcagatagaaaaggagggagctactctcaggctgcaagtaagtatgaaggaggctgatccctgagatccttgggatattgtggttgggagcccatgggggagctcacccaccccacaattcctcctctagccacatctcctgtgggatctgaccaggttctgtttttgttctaccccaggcagcc

SEQ ID NO: 15009 - DNA, 1226 bp, Homo sapiens
ttccctgtctggatttctggttttacagaacttttaaccagtgtgcagattgcctttactttcttgccatctcatcaaaggattaaaaatattcatagtcagatatatcttttaaaagtatttttttcctatcactggttgtcattttaccaaaaaaaaaaaaattttttttaaataaaaagaagattttttttcccagcgtgtggcttgcctattttcttaaccctctttaaatgagcagaagttttaagtttttataaggttcagcttatccttttttttttcttttacagctagtgctttctgtgtcctaagaaatctttgctttgaggttataactcattggatatatttttaatcccagaatttttagttgtcttggaattagaattggaagtttgtttaggggagccagtcctcaatgatgtcataaataaaagtccttccttgattatttgattgcatatcttatcttatactactagaaactcatcttttggtgaatataacaagtcctttctttcctcataggttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgacatatgtatgttacttataatctgtcttattccaaaaggaatttaaatgagtttccagagatatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacagaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaagccctcc

SEQ ID NO: 15010 - DNA, 1225 bp, Homo sapiens
aatgctttccctttccattattcttttcttcctccagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggtcagagcccagatattcttccccagccccctgctatagcgtaggtaaaagggtgtgggctttgtggccagagagagggtcaaacctggattctgtacctgttggctagctctgttacttaacatctgtgatattttcctgatctgcaaactgagggtaataattgacccttagcatagtgattgtaaagattgaagttgatgtgcacaaaggttctgttcagcaatctgcacataggaagttgaatgaatggatgaatgaatgaatgccagcagctctaaagattattgttattcctagtctttgcctcttccccatctttccttggctttagttcttgctcaaaactctcctccatttttttcttgttttggttccccaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttc

SEQ ID NO: 15011 - DNA, 2417 bp, Homo sapiens
ggcccatttctggtgtttgtctctccttcagaaaagttggtgtatggacgaggtcaggagatcgagaccatcctggctaacatggtgaaatcccgtctctactaaaaatacaaaaaattagccgggtgtggtggcaggcacctgtattcccagctactggggaggctgaggcaggagaatggcgtgaacccggaaggtggaggttgcagtgagccgagatcgcgccactgcactccagcctgggggacagagcgagactccgtctcaaaaaaaaaaaaaaaaagttgatgtatggagctgcagcacctttttcccttgccctcctcttaactactttgtcttcccttgcagacccatggggaaatgagaaagaaccaccggctggtaagttggcattgggatttagggaatgataatctgatggaggaagtgtgactttaaccgaccacctccctctcttctcgggcagaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtaccacttcaggggccagggagggtgcccttcaccttatcattcatgtctacaaactgtacctagaggaaccgagaatgagggagcctcagctcacaaactggcacatcttgagggtttgccttcagaatgtgaggtgctaggtgtgacagccctccccttcctttgctacaggtggtcagaaggcgcgagttgtgtttgctgagctggcctgtcgggaacctgatgtcctcatcttggtgagtgagctgggctgtgggaaaagggataagggtaacagtaatggaagacgggagttgcagtgctcagtcatggaattcctcctatgtaggacgagccaaccaataacctggacatagagtctattgatgctctaggggaggccatcaatgaatacaagggtggtaagtcagctgagagtgtgccctcatccctgctccatggggaccaagctgtagtgtccttcactacagaagggcctaggactcccttatttcatgttctgattcccctctttctcctttcttcctgccctctgttgttgctatctttcttcaaagctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaacatgggtctctttcctttttttttttttttttttttttgacagaatcttgccctttcactcaggctggagtgcagtggcatgatcttggctcactgcagcctccacctcctgggttcaagcaattttcctgcctcagcctcccgagtagctgggattacaggcacacaccaccaggcccagctaattttagtgtttttaatagagacagggttttaccatg

SEQ ID NO: 15012 - DNA, 1162 bp, Homo sapiens
atttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggatagtaagtgtcgaattttcaaaaaccagccttgcaacaagaaatcaacgtttcccgttgtgaaaccaaaaataatgagaggaagaaatgagaccatagaacaaatagagaactggagaaggaccaatctggtcacttaatctccattaaaaagggcctgtgggtctaaacagtcttgttctctctcccctaccacctatctcttccctgccttgctgcaggcaaagagagggtggagggagggccagcaagtgaggattttgatggttaacccttggtaatccagccaatttccagactgccaaagccatatgtgtttatataaggaggaatggttaccttcctctggttagcagcagtcttcaaaagggttaatgagctcacatacaagagatggtggatcttgtggcccagaagtaccacttctttgtgtgtgagacaagcagggtgcctttcaatttgccagattaataagcaatctgtacataaagattgcagggtaaggagatgggcagagagaagtaatagctcgctataactttttaaatgactgttaaatcctctcaattttaatgta

SEQ ID NO: 15013 - DNA, 1138 bp, Homo sapiens
gacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacagggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatc

SEQ ID NO: 15014 - DNA, 1165 bp, Homo sapiens
ctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaattggggcacaggtagggcactggggaggaaaagcacccaaaggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgag

SEQ ID NO: 15015 - DNA, 1207 bp, Homo sapiens
gttgttctagacttttcttgggaatagcttatttggtatcttgaataacatacagaggtgtatctgccctttgggtatataataatagagccaggcacctttacacctagccctgcagtcaaagaggaaagataacttttgaccatacacataaggatctaggttggggctgggcatagtggctcatttttgtaaaccatcccagcactttgggaggccaagatcagcccaggcaacatagtgagaccccaactatacaaaaaattaatggtgcactgtgatgtgtgcctgtagtctcagctacttgggaggctgaggcagtaggactgctttgagccatgatacgccactgcagtccagcctgggcaatagagcaagactctgtttcaatttaagaaaaaaaaataacaacaacaaaagatctatgttggaaagaagggaactccattgatcttttctctctcctaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcactttatctagacgatggcgacaaatgaggccactggaattcaggtagaaagtggagtaggcatcataggtcctggggaatagaggga

SEQ ID NO: 15016 - DNA, 1169 bp, Homo sapiens
tgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaactcgtctgcttctccttctttgggaaaaaaaaagggtatgtgaggggaggctctggtggctgggggagaggaaaatgatgggggatgaaccaggaactcggcactgacatgtcaaaaggggtctgggaagctgcacgtgggtttcacgcaggacaagcaggtgacatgagaaagggcagttgaagtgtccactagactggaagtgccatgagggctgactacatcagctggattcactgcaatatcctgtacctgtcaactagtagacacggaattatttctagaatgaatgacaacaaatgaatgaatagaagaaaagggttaaaatattacagaggacactttgagttgaagggttctagtattcagaagcctgctgccatgaaggcagctaggtagtgtatgacac

SEQ ID NO: 15017 - DNA, 1200 bp, Homo sapiens
gagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacaggtagggaagcagccaagccagacttcttagaagtccacttgtcaattttctctggactctggtctctttcttttttatacccctgttttcttgtcttcctctattctttcttgttaattcctgccaccacccttcctcgctctgcacatacacccttccttctcagagccctccttttccattttgagcccaaaagatcctgccccagcaaaggctgtctctgggtgtgtctctttcagggtgtgccaggctgctcattctcccttcccttgggctctgagtttccaacccccttttctttccttcctttcctgagtgtgacctgccccagcccatccagtgggagagcctaaagtgacgagcttgaatcagtgagggcagggtcaccagggtgagagcacttgcagtttttctggggagaagggatagggagcctggggtggtggagggggtggggtgggtttgtgttctagggagaaactgcagggagaagtgaatggagaaaggtccaactgcc

SEQ ID NO: 15018 - DNA, 1100 bp, Homo sapiens
aaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactag

SEQ ID NO: 15019 - DNA, 1139 bp, Homo sapiens
gtggctcacgcctgtaatcccagcactttgggaggccaaggtgggcggatcacccaaggtcaagagttcgagtccaccctggccaatatggcaaaaccccatctcttctaaaaatacaaaaattagccaggcatggtggcaggtgcctgtaatctcagctacttgggaggctgaggtgagagaattgcttgaaacccgggaggcagaggttgccgtgggcccaagatcttaccactgcatgccagcctggggagcagaacgagactccatcacaaaaaagaaaaaaatgttttaagtgcttcagaaggttaacaacagaaagattggtggaaagagaagcatcaacgttcataatgatccagtttaccccctagttttcagtctgataactctgatgctgtttgtgtgaaccaataatgaggataattgataatgtgtatccttcccagatcatggaggacacccaggctattgactgggatgttgaagaagaggaggagacagagcaatccagtgaatccttgaggtgtaacgtggagccagtagggcggctacatatctttagtggtgcccatggaccagaaaaaggtcagagggtattggatgttcaagtattgatatagatcttttatttttgtggtaaggtatttggagggttgcaagaagcttatgtatgtttcaatgagatgtgaatttttttttttcatgaatggaagagatggggccgattgagttgatagttgcagactactaccctggactcactggaagtgattttactttgataaaagaaaattaagagattgaaatgaagctgggtgcagtgactcacacctgtaattcccgtgctttgagaggccaaggcagaaggatcacttgagactaggagttagagaccagcctgggtagcatagcaaaaccctgtctctacgaaaaatttaaaaattagccaggtgtggtggttcatttcacatctgcagtcccacctacttgggaggctgagccagatgatcacttgaacccaagagttcaagattgcactgatctatgatcatgacactgcattctagcctgggtgacagaatgagaccctgtctcaaaaaaaaaaaaaaaatcaaataaaatccaattgtgtgctc

SEQ ID NO: 15020 - DNA, 1107 bp, Homo sapiens
cgccactgcactccagcctggtgacagagcgagactccgtctcaaaaaaaattaagaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatggg

SEQ ID NO: 15021 - DNA, 2192 bp, Homo sapiens
actgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctt

SEQ ID NO: 15022 - DNA, 1218 bp, Homo sapiens
gaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgcagtcttgagtgtatctttgcaagcgccgactccccactcctcccggccttcagatggcaaggaccggcgggagg

SEQ ID NO: 15023 - DNA, 1200 bp, Homo sapiens
tttctgcagtgccgcttcctctttgcggggccctggttactcttcagcgaaatctccttcatctctggtaagccctggagtagcccagtctccagtccctgaaattgacaactgatttcattcctaaccctgcagtgtccctaaaatactcattccttgcattatatctacccatcacccaccgaaacttctcaattaggggtgccccaaataacttgagcccctttctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagcctgtggagagggcaccttgaca

SEQ ID NO: 15024 - DNA, 1154 bp, Homo sapiens
ctgggaagaggtggtaagcttggatctcagggtcacaagggccctgcgtgctccctcactttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggaggtaagggtgggagggggatacccggggaccttccctttcttggcctaatttccattgcttccatcactggctcgtagctctccgtctttggtgcagtggttctcagtgggatggagtgaaattcctcagttctgctgggataaggtccagagccaacccttccaggatcctgccttttcacaccaccacctggctctgctgacacatctagtcacagacccctgtgatgctgttactcagcaagtccaaagcttgcccttgtcacccccttcccacctgcacagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtgagtgccatgtctctctgcgggctccatctctttcccctgtcaccacctcgctttccctagctctggctcctccaactgctctagggctgttggctttggacagaatgtccaagcagtcaggcctgtctcagctcattctctaatgtcctcctctaactgctctagggctgttggctttggatagaatgtccaagcagagtcaggcccgtctcagctcattgtctaatgtcattctcctttctgtcattcacttgcaggtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctcc

SEQ ID NO: 15025 - DNA, 1338 bp, Homo sapiens
ttcttgaggacaggaattcaagaccagcctgggtaacatagcaaggccccatctctactaaaaataaaaaaactaacagggcacagtggtccaagcctgtagtcccagccacttaggaggctggagcagaaggattgctttggcccagtagatcgaggctacattgagccatcattgtactccactgcactccagtctgggcaacaaagtgagaccctgtcttaaaaaataaaaataaaaaaagtttctgtgggggacctgcactgaggtcctggaggggcgccagttgtgtctcccggttttccccttccacagacaccattgccaccaccattaggcaaacatccttcgcctcagtttctccccccacctccctctcctccacccatccagggggcggggccagaggtcaaggctagtgggtgggactggggagggagagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggaggcaagtgagcttcgacggggttggggtgtggggaggtggtcatgacagggcagcctgatggggaagtggtcacctgcagctgcccagacctggcacccaggagaggagcaggcagggtcagctgccctggccagggaggggtgtgtatcaactgctggcagccctggcaggcaggggccaggtgggaagtggaagctggatttcgaagagacaactgccggtgagggcagagcagcctgggagagtcggaagctggcccaggctggcctttgctctggcccagcccttgtcagggtctctcacatctcctaggcctgcccagggtctggtcactcattactggcccagcaccagacccagcttggggttggtttgagccccttttcccacccttagtcctgcttgaaaatttgacccttatc

SEQ ID NO: 15026 - DNA, 1315 bp, Homo sapiens
ttctgaactctgtgctacctcagaggccagcttccttagggaaaaatcagtgctgaagtaaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggtgagctgaagatgggaaagatattttgtgtccttgggagaaaaagacagttgagagaagggaatctcaacatgttttaaatttcctttctcacaaaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtaaacctcacaggctgaaaaaatcccactctcccattcccttgttttctgtttgtacatcttcattcctgcctctgggtctctttcctcttcggtcttccagtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacagtgagtactgatctcatgaaaccctttaggtcctccctgttccttagtgtgtttgtccgaaatcccatcacataggtcatgggcatctgatgcataatggacacttgactggttcatgccccctggtctttgatgctgtgttgggatgtttttctgacctttatgtggggtgtcttgtcttctctcatcatattacatcccttccctcacccccacgtccgtcctctgaacccaggcagtacaccagtgtctgcatgtgtgccgtgtgttcctgcctcactttccccttttcatgccttattctgaccatgctacgttttcttctcagttgaacagacacggtagaagactcgcccattttggaatgtgaccgtctgtccttcaggagaggacaccagggtgggggtgaaggagacactactgcccccacccctgacagcccccaccccatggcttcca

SEQ ID NO: 15027 - DNA, 1315 bp, Homo sapiens; identical to SEQ ID NO: 15026

SEQ ID NO: 15028 - DNA, 1166 bp, Homo sapiens
gtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtcggggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaa

SEQ ID NO: 15029 - DNA, 1166 bp, Homo sapiens; identical to SEQ ID NO: 15028

SEQ ID NO: 15030 - DNA, 1185 bp, Homo sapiens
tggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccg

SEQ ID NO: 15031 - DNA, 1185 bp, Homo sapiens; identical to SEQ ID NO: 15030

SEQ ID NO: 15032 - DNA, 1189 bp, Homo sapiens
accacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctc

SEQ ID NO: 15033 - DNA, 2159 bp, Homo sapiens
ccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctac

SEQ ID NO: 15034 - DNA, 1047 bp, Homo sapiens
aaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtag

SEQ ID NO: 15035 - DNA, 2094 bp, Homo sapiens
cagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagca

SEQ ID NO: 15036 - DNA, 1128 bp, Homo sapiens
tgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctacggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtg

SEQ ID NO: 15037 - DNA, 1150 bp, Homo sapiens
tcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttca

SEQ ID NO: 15038 - DNA, 1182 bp, Homo sapiens
ggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctattccaaaatgcgtttcctcatgggtctggtttgttgtctgtttctcctgctttgcaccttccagtctagaatttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccag

SEQ ID NO: 15039 - DNA, 1211 bp, Homo sapiens
ttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggatagggcagggctgaaacctgagtttggggtcagtgcagggaagaaggcctcttattcaaaaatcttgttaggtacttatcaactcattgcccaaccatgtcataggtacttgagcacaagatgaacaagacagaatttctatcatgggaagtgtgtccagggcagagaaaagagtgtatgggtggattgctcactgaatttatctaaatgttagatgattcagagactggtagattaccagtccacccctatttgataaagaaaaagaaatgacacttccagggacattcattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgcgccctagggcatcaaagtatatgcaaggggtggccaaggagggtcacctt

SEQ ID NO: 15040 - DNA, 1157 bp, Homo sapiens
ctcccacctgtcctcagtgtctggggaaccagaagcctgcctttgcaaaacagtttcccattgatctgccttaggtttgacccaggcccaagggcaaagagcccatagtgaggggacagtgtatgtgtcatgactaggcagaaaacagctggtctgggagtgggaatgcagggactggcctagggatgggtggggtgcatcaggcataaccttgggttggggttacttttcaggctggcagtgatggggccaagattgggaactgcccattctcccagagactgttcatggtactgtggctcaagggagtcaccttcaatgttaccaccgttgacaccaaaaggtaggcctgcttatgttccttgaaacacccctggtgtacacatgtgtgcaaacacacacccacccgagtccttctgtcatgaacatttttgccctccccctggagtccctttcttatcccacgtcctccattccccctttctggttcttcctgacccccatttccagtcctgattcctgatcctttctccaggcggaccgagacagtgcagaagctgtgcccaggggggcagctcccattcctgctgtatggcactgaagtgcacacagacaccaacaagattgaggaatttctggaggcagtgctgtgccctcccaggtataggggcactcagaaagtggagaggtggagcagggagattctgggaaacagacagtttgcagaaatggaaaacagagatggtggtggggctggggcaggagagctagctgaggttcctcccaggaagacatcttacctcatttttcccattggctttcaggtaccccaagctggcagctctgaaccctgagtccaacacagctgggctggacatatttgccaaattttctgcctacatcaagaattcaaacccagcactcaatgacagtgagtcttgtgggtcagaggcctgggtcctgggaggaatagagaggacccagcgggtaggagacattaggggcacctggacgttcagatatcagggagatgaagcagatgttcgtaaatttcccccagcttcccatttttgctttacctctatatttccctgcattttcattggccaagacttttaagcttttctcatttgttccctagcctcttctgccccact

SEQ ID NO: 15041 - DNA, 2504 bp, Homo sapiens
tctgcaggtctacctccatgccatcgtgcgagatgctcacggccggaagatgagcaagtctctaggcaatgtcatcgatcccctggacgtcatctatggaatctccctgcaggtgggctgggtgctgggccagccaggaagggccgtggggctgtggtcacagccacctgactgctcccactccaccctcagggcctccacaaccagctgctgaacagcaacctggatcccagcgaggtggagaaggccaaagaagggcaggtatggagggttgggctgggctaagcaggagcacagcgtggatggggctggctgaggacgctcctccccctgcctcttccctgtagaaagctgacttcccagcggggattcctgaatgtggcaccgatgctctccggtttggattatgtgcctacatgtcccagggtatggcccccaaagcgtccctcccagccactccttcctccttctgtgaggcccatccctcttctccaccctgagcctctggtgggcatgggctgggaagagggtgatgaggactcacatctcacccccgacccaggtcgtgacatcaacctggatgtgaaccggatactgggttaccgccacttctgcaacaagctctggaatgccaccaagtttgcccttcgtggccttgggaagggttttgtgccctcacccacctcccaggtaagggcctggtgggcagcaaagctggcagcactcacacaggctgtacccctgtccggagcagcctccatgtagctggggggacagatagacacagagacagacagttaaagggaaagcccagcgcattgggggctggggcctgtcacttcttcccagatcctggcacataggtggttgctttggactcatcagactctggatgaagatttgcccatgactcctgcccccatggggttctggcaccctcccctggcccgccggctgatacaccctctctccccaagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggtgagaaggagcacagcggggcaggggatggtgggggcaggtgggcagcagagccctgggctcagttttgccagagttggccttgagacctaagccaacccatccccttcccagtcctcacaggcacagcgagggctcaaggctagacctccagccgtgagccctgtacctctcgtcccctaggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagaggtatggcatggcctggagaggggagtctgacctgccctccaggccccctcaccccctcctccaccccacagtgctcctggaaggaccccgaggcagaagccgcccttgagctggcgctaagcatcacgcgagccgtgcgctccctgcgggccgactacaacctcacccggatccggcctgactgtgagcctcaggcccccatgtccgccccatcccactgtcccctcagcctactctgggacccagtgtccggcagtgactgcttggtttcctgtctccatggagctaggcctcacctttctccctccctggcaggtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaaggtgtgtggcctgggtgggcatttcccacaccatccccttcctccatcaaaaccctggtctgggctggtccgagtgcagtggtgttgacaactaattgatcgtaaccagttacagatttctttgttccttctccactcccactagccttaaaaaacaaaacagcctggctcagtggctcacacctgtaatcccagaaatttgggaggccaaggtgggtggatcacttgagcccaggggtttgagaccagccaacatggtgaaatcccatctctacaacaaaaatacaaaaattagctggccatagtggcacacacttggggtcccagctactcggggggct

SEQ ID NO: 15042 - DNA, 1102 bp, Homo sapiens
aatagagacaaggtctcactctgttaaccatgctgatcttgaactcctggcctcaaggaagcctcctgccccagcctcccaaagtgtgggggttagagatgtgagccatggcaccaggccccttcatgcttttatttatttatttatttttgagagagggtctcactctatcgcccaggctagagtgcagtggcaccatcttggctcactgcaacctccacctcccgggttcaagcagtacttgtgcctcagcctcttgagtagctgagattacaggcacgcgtcaccacacctggctaattttttttttgtatttttagtagagactaggtttccccatgttggccaggctggtctccaactcccggcctcaagtgatctgcccacctcagcctcccaaagttctgggattacaggtgggaatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgggcaaggggctggtcctgtggggagaggaaaagactggagctgcaccctagctgtccatcttctctcagagaaaaagaaaataagcttcagccaaatagacagagcttggggtggttctcaagggactgtattagacaagtgggggccaggagtggtctcggagctacatccttcagcaaaagaggtgagtgtaggaaggaactccgtggagtccctcatgacctgggcatcctgatgtacacccaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgag

SEQ ID NO: 15043 - DNA, 1099 bp, Homo sapiens
ggactacaggcgcccgccaccacgcctggctattttttttttgtatttttagtagagatgaggtttcaccatgttagccaggatggtctcgatctcctgacctcgtgatccgcccagaagtatttttattgtgactatttgagtgaagaaatgggactcagaggtggtgatttgtgagagtggggtggagggaggccacatggattgggttgtggtgggagatggaggtgggccaaaccttgtctcacacttcttccccttcctgccaggctgtgctgggggccctgggcagggccctgagccccttggaggagtggcttcggctgcacacctacttggccggggaggcccccactctggctgacctggcggctgtcacagccttgctgctgcctttccgatacgtgagtcaccaggcctggggaagaacaagactgctctcctcagacctcactgtagggtgactgagaagagtcatttatttcctgttccaggtcctagacccacctgcccgccggatctggaataatgtgactcgctggtttgtcacgtgtgtccggcagccagaattccgagccgtgctaggagaagtggttctatactcaggagccaggcctctctctcatcagccaggtgaggaagggcgaggagttggaggataggggcttccctggggccttccatgcaactcactttctttttttcctagaaatggcagaatcactggggcagggtcctgcgggagaggagggagaggggggaggtcagcatgggcaagacctcgggcatctaaaataccccatctgaaacctagtatggccgtccaagagggtccccagctggctgagtctgaatttctgcacctctctctaggccccgaggctcctgccctcccaaagacagctgctcagctcaagaaagaggcaaagaaacgggagaagctagagaaattccaacagaagcagaagatccaacagcagcagccacctccaggggaggtgaggcgagggtggagctggaaggaaagttgatgtgtgcggtgatgggttggctgatgcctgggcctatgtcttctccctcccaagcagaagaaaccaaa

SEQ ID NO: 15044 - DNA, 1143 bp, Homo sapiens
tcagttctaaaaagaattaatctacttcttcaattgtggggcctgtggcaggccttccaggcacataccctgttccgcaggcaggcccagtgcatcctccttggtagagttttgtgatgatagggttacacatctgctccaattcctttctcttatgatcaaactcatctttctctgccagttgattgacctccagccacgaaaggagctcgttgcatttatccaatattttatttttatcagactcactaatcttgcccttcaaaccttcatcactcacaacactcttcatgttaaaagcataggattctaaggcattctttgcagcaattttctccctctggacctcatcttcagctttatatttctcagcatccagaaccatgcgctcaatctcctccttgctcaggcggcccttgtcattggtgatggtgatcttgttcaccttgccggtgctcttgtccgtggctgtgacattgagaataccattggcatcaatgtcaaacgtcacctcgatctgaggaactcccctgggtgctggagggattccagtcaggtcaaaccgccccagcaggttgttgtcctttgtcatggccctctcgccctcatacacctggatcagcaccccgggttggttgtcagagtaggtggtgaaaatctgtgtctgcttggtggggatggtggagttgcgctttatcagggcagtcatcacgcccccagccgtctccagccccagggacaggggagccacgtccagcagcagcaggtcctgtaccttctcagacttgtcccccatcaggatggctgcttgtaccgcagccccatatgctacggcctcatcagggttgatgctcttgttgagatcacgtccattgaagtagtcctgaagcagccgctgcaccttggggatgcgggtggagccccctactaaaacaatgtcatggattttagccttatccatcttggcatcccgaagcgctttttctacaggctccagggtacccctaaacaggtctgcacacaactcttcaaatcgagctctggtgatggatgtatagaagtcaatgccttcataaagtgaatcaatttctaggttggcctgggtgctggacgacagggtcctcttggccctctcgcaggcgg

SEQ ID NO: 15045 - DNA, 1417 bp, Homo sapiens
cctgaaggctggcatgtacctggtgtccaggcatggagtagtgcagagcttctcagatttcagtgtacataagtatttcctggaggacttggggaaacagtcctgtgcctcccagagagattttgaatcagtaggcttgggatggggcccaggattctgcatttctaaaaagtccccaggcaatgctgatgctgaaagtccatagaacatacaaggggctcagatcccatctggagaagataggttgggtgtcgggtccctctcagggagcaggatccacagggtcttcggggtgggctcttggtggctgggtccaggtcccacaagctcctgttttcctctgacaggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaactgcgatttttgtgttggggtggggagaaagcatacttggctagagggaatgtgggtccaagggccagaataggatgggaagcaggctggacaggtgtggctggtgtgatggccgcccagtgcggggcagggaggtggggggccactatgaagatccagtttcacaggcacggtggctgacacctataatcccagcactttgggaggccaaggcaggcgaatcacctgagatcaggagttcaagaccagcctggccaacttggtgaaaccccatctttcaaaatagaaaaaatttgctgggcgtggtggcaggcacctgtaatcctggctactccagagactgaggcaggagaaccgcttgaagccaggaggcggaggttgcagtgagccaagattgagtcactgcacaccagcctgggcaacaagagcgaaactccatctcaaaaaggaaaaaacaggtccaatttccacactttaatctttggcgggagcgtgttgggagtgtacggcagttaaggtagttggcgagattataaagcgttttcttatcagagcatgccaggt

SEQ ID NO: 15046 - DNA, 1108 bp, Homo sapiens
gaccgatcatggggttgagctgacctctgcctcctcgccccagcactgcacgtgtgtggacgactgctctagctccaactgcctgtgcggccagctcagcatccggtgctggtatgacaaggtgcgtgccccttgccttggccacagacacccggcccctccttcagaggagccagcctccaataaaccagctccctgggaccatgtccctcacctcctaccctgtgggggaagtgactgagaggactgggcaaggcctgggaatcctgggatgtggctgggacagcgatgggcgtgtgcccaggtctatgcaaaccagggatgatgctcctgcatttcgtgctctcggatctcagagcctgtgtgacctccccaaccccaacttccctgtctctgtagagtcttggggttcctgggtgggcagctgaggtgggccccacagagaaaccactatcctcccctccgcaccctaggatgggcgattgctccaggaatttaacaagattgagcctccgctgattttcgagtgtaaccaggcgtgctcatgctggagaaactgcaagaaccgggtcgtacagagtggcatcaagtgaggccctgctccacagcccaccctctccccacctcaccctttcctccctgcccctggggcttttccagggcctccacccaacagcgccatctctcctacccccagggtgcggctacagctctaccgaacagccaagatgggctggggggtccgcgccctgcagaccatcccacaggggaccttcatctgcgagtaagtcaccgggagcaccttaacacctggtgggaaggggatacatggccactgctgactgccaggcctccctctcagccatctgccctgatgagtcacatgtctccatctggccactctccagccagcctcctctgacccctattcctgcagctgagcagccagccgcctctgacccccatccccccagctgagaatggcacctgcctccactctgcccagaccacagagcttgtcttccctcccctccacctccaccctctaccttcccctccaccccctcctcgcccttcctagctggagaaagtgccagtttgggagaca

SEQ ID NO: 15047 - DNA, 1195 bp, Homo sapiens
gagaatggtgagggccaaagctacaccctgaatgagttctggtggagctagtagcatttcttagtgtgaataatccattttccctgaaagtagattttcctgggaaaggagtgagcagaaagaagggctcagctacagtggcccttcaggcaaaagaaaggaactagaattgaccagcatgtcaaaaaagggctacagaggttttctagtttttagcttctgacatactgactgtaagtagtgggttaatatcattcacgtgtctcaacaatgacatttgggatttttctaagaacaaaacattcatcaaaatgtccacttatacttttcttggccatgggttggcacaaaggagctaaggaagacaggccatcctggccaccagagggcagcgtggaaactgggcttccaggggccagtggccaggagtgaggtggtcaggagtcagcctcagggtctgttctatgatctcctttagaccttaactgttcctctcctccctccctagctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacctgcagaggcagtggggtgccatggatcattcagtagaattcctaatcctggaagcatggctgttcctgcttgtgtcttagctgacctaaaggaatcagactagggacccagctcagcctcgttcttgacacacgcaggcaagacatgcggtcctaaggtgag

SEQ ID NO: 15048 - DNA, 1327 bp, Homo sapiens
cccaggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggg

SEQ ID NO: 15049 - DNA, 1122 bp, Homo sapiens
tacactcttccctctctgcccccacaaggctctggcggctctttcaatctctcaggatctggagacatgtttctggggatgcctgggctcaacggagattcctattctgcttcccaggtcagatgcccatctcctctcgaatagggctttccccaactccatttcctctactttaggatacaagacctctttcctctgaggcttctcttcactgtcataccttcctctgctgcctgcaggtggaatcactccgacactcgatggggccagggggctatggggataacctcgggggaggccagatgtacagcccacgggaaatgagggtgagtggatcctgaagctcctctctgtccagttctcacaggacagaggggcattttccctagtaatgttgtgcccacacagggttcccagggctttctctgttttctgtactctgtctctcctttcaggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaata

SEQ ID NO: 15050 - DNA, 1262 bp, Homo sapiens
cgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttacctttttttggaggaattggggagaagaatgggaaaaaagatgggagtgactgcataatgtcagcattttgtgcttttggctcagcatttggattggatggaggatgtaagtatagtttaaaagcaagaataagtatatttaggggccctatgataatttagggtattatctgaaagcaagaatctagtagccaagggagaaaccgcacacactaggtcaggggtccccaacccttgggccacagactggtactggtccatggcctcttaggaactgggccacacagcaggaggtgagcaagcattactgcccaagctccacctcctgtcagatcagcataagcattaaattctcataggaactcgaaccctattgtgaactgtgcatgcaagggatctaagtttctcgcttcttacg

SEQ ID NO: 15051 - DNA, 1262 bp, Homo sapiens; identical to SEQ ID NO: 15050

SEQ ID NO: 15052 - DNA, 1103 bp, Homo sapiens
agagaagttgagcagatggggtgggagatagcgtgcaaaatataggtgcagcagaggggcattccctctcatcctgctgttacggcggtcaatctgagatgcggtggaagtacgggccgcgtgagtttccccccccaactcccaccctcaacaccacactggccctccgctccagcttactggggaactggcatggaacacagtgtctgtggaaaggggggggaatctcgtggggggagactgtctcccggtctcaccgaccccagaacaatgccccattgtccctcccgcgcactggtgacgtcaccagggcaacacttcctgcaggccggtggtctcctgggcaacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagccgataaagatgcccaggacaacagggttagatgggacagagggcttcccacaaaacagtcaggcgcacgagagatggaaagtgcggtaacccgcaaagcctgaagggataggggccagtggtcgcgcaagtgaaggcagaaaggcccagtcctgtgggcgtggccttccctgatatcggccctggctcttctgtacaggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagactt

SEQ ID NO: 15053 - DNA, 1326 bp, Homo sapiens
atttgacttgcacaagtcactaacctttcagagactcagcttccttacgtgcaaagtaaaaatcgaatgagataacccaaataaaatgtcattagggggatttttaggttatgtatataaatcatgcaataaatgctagtcatttctttcctctggttgactgagagcttccaggaaataggaatgggttctaactttctttgtattcctagtgcctaaaacggtgcctgacacaaagtaggcactcaatagatgcttatgaattaataaagtatgagagagcctggtaggtatttagcaggggaggaaggttttaccaaaaatggtgctgtgtttggtggcagtgtgtcatagagattgtttgggactggggaagtttgagttgtgtgtcgccaacaattgtgtctcatggggagttgagatagaaggattgtgacacatggccatgatggatggtgagttgagtgatgctgttgagctggaaggtgggggactggacagactatcttgagctgggtcccttgtagtgctgggttgggctcatccactggttccctgtctaatcctctttgtctgcagtgtgccccaggctacgatggacagaactgctcaaaggaactcgatgcttgtcagtcccaaccctgtcacaaccatggaacctgtactcccaaacctggaggattccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggtgaggccccaagacaaggggcacaagtgtgtctggagcacagccaagcagaccatggagagccagatagtctccacccatgcggcagccgtcacctggtccatcccctgcctccacgcccacccccgcccagaaaagatgccccaggatcccttcacctgcacatctagcactgggccaacatccaggaatgagctaggatggaggcagtgactgatgcagtgtgtgacatctaatctcccccataattacaggccagtggtgtgaggtggagatagacccctgccacagccaaccctgctttcatggagggacctgtgaggccacagcaggatcacccctgggtttcatctgccactgccccaaggcaagtgaccacaaatctgccttctctgttgccccctatgctgacaaggcaagaatacctcagttggaatcccagaagggactgtgggtgagcactgatgtggaaattattggaaaaagccatgcca

SEQ ID NO: 15054 - DNA, 1209 bp, Homo sapiens
cgagaccacaaacccaccggaaggaacaaactcaggacacaccagaatgatggtagaggtgataaggcatgagacagaaataataggaaagactttggatccaaatttctgatcaggcaatttacaccaaaattcctcctctccacttagaaaaggtgtgctctgcgggactattggctcaggggagactcaggaacttctttttcttcttcctgcagtgctctcatctgagcccttgaaagaggggaaaagaaactgttagtagagccaggttgaaaacaacactctcctctgtcttttgcaggattcctgagctgaaatgcagatgaccacattcaaggaagaactttctgccccggctttgcaggatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatggcagcgcctcatcttcaacttttgtgctcccctttgcctaaaccgtatggcctcccgtgcatctgtattcaccctgtatgacaaacacattacattattaaatgtttctcaaagatggagttaaatatcatctggtccatttggctccaaagacagaaaatgaaaagaaaaagggaagattattttccaatagaataatgattttcatgtatatgtcatgagtgtgtgaggtaatgcgtatgttaaatagctggatttagacattccacactatagccatatatcaaaacttcatgctgtacaacataaatatactatacaatttttacttgtcaattaaaaaagtaatcctaacatttaaaaaggcaatgcataaaaactgagaacagactataacaactgaaacaaactgggcaaacatgagatgagaaaccagccagcaagtcaatcagaactctttcttcatctcgtctacaatattttgtatttataactgtaaattagtgtatagtgtttcactccagagacttcaataatacagtgttatcaaaggacttgtacagatttcagagaaagacacatttagaagatggagagttctccgttatgttctatctgagagtcagtatgaaatgtcaaatctaaaagtacataattcagaggtctatttcaaattaataatcatttgagcata

SEQ ID NO: 15055 - DNA, 1129 bp, Homo sapiens
ttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcagggcggcggcacaggggtgtggggcgccgtgttgggagtactgagcggccccggcgcgctgctgttgcggcgcagctgtcgactcggtcgcgcggagggaattgagcgacggttttggaacggtggtggcggctcggctactgctcgtggaggggaatacaggttgtcaatttatacgctattaatgccgccgtggcccagtcttaac

SEQ ID NO: 15056 - DNA, 1173 bp, Homo sapiens
agcttggggtttgagtttcttaactccacccattttgcttaagccccatccccatagggctgtagttctgagatgtcgtgccttgtcagaaacaatttgggagttttttaaaatatgaaaaagaacagatagagcctatcagacttaagaaggtgggatctagatagtatactaaaaatattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctagggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaact

SEQ ID NO: 15057 - DNA, 1927 bp, Homo sapiens
agctggtagtgaccatccctaagaacagccacaagaagggggccaagttggcaggtaggaagagtgggagttttgcaaatggacaactaaagatggggaagagaatcaaactacacttttttccttttttctagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaaggtatgatctgtggatttcctctgggcagcagggaggcaagggtcttaagtaaagtgggcttggagtgacaggttccctatcttgtttctttctgcagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaaaacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttgtaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacaggtattttgtcactcttgaaagtttttattgggtaaga

SEQ ID NO: 15058 - DNA, 1342 bp, Homo sapiens
agcttgagcgctatgtcctttcctgcctacgtaagaaaccccggaagccctacagtacgtatgaaatgaggttcatctcatggttctgaggacagttgaggaaagatggtggggtctgtttgcattcaggattgtcagctcccaggataatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagct

SEQ ID NO: 15059 - DNA, 1661 bp, Homo sapiens
gctggggggcactgaggctcccttgggggtggggagtgctatgaggatgtgttcagggcccgtgtgcttccagctctcaatccccttctcccacctccaccccaggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctggactgaggtgactgtatgaggatgggcagcgccgtttcgggcttggggggggtatccggttgggagctccggacgcgatccctggacgccgccgccgaggttccgtggggcccaagaggtgcacgcagggtgggggacacaaggcaagctttgtcggggagggggggagagggtgtgccaggctgggggcggggccggccggaggaggaagggggggcggtggattctcaaaggcgccttgttcgctcgtgccctctccgcgccagcgggcggcggcgcctcggctcgctgcggccttccctccgggcgcgctgcg

SEQ ID NO: 15060 - DNA, 1285 bp, Homo sapiens
gaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgtgagtctccaggggatgggagagagaagggctggttctggattgttgggaaactccacagtacttgaccttgactctccctcaccaggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttggtaagtaacctctgacttctacctcaaatctaacctatttcgttctttggaggaaaagggttctttctcctttatgatccctgacctttcgatattcccccaaatacacactcattgtgtcagatattccctcatctggttttccccccttcttccagaacctcattctcaccacactctggagcaacccggacatggacactcccacagtggtgaggaagagacagatggggatgggagttggggtgctggggaaggtccgtctctccctattcctcacctcccgcacttgaggaggaggagtctggaatgcacatctcccttaatgtctcaatgcctccattcccaggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtg

SEQ ID NO: 15061 - DNA, 2468 bp, Homo sapiens
cccaggaacaactttcctgaaagctgacttgcctgcctcagaatctcctcatcttatggccctcaggagggagaggacatgttggaagatctgttctccactctgaccaactcttttcttccctcagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttaggtaagggccagagttggtgataaatttgggcaagggacatcatcacaaatcacatggaatatgtgctgtgggtaatggcaggtatctgagaaacactaaaggactgggtgtaaagtggtctctgaggggaggtgtgagaatagctgaccaagactggaacaagtggtgatggaagcctctgatcattttctcttcttgtcctgtacaagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggttggtgatgtctgccaaacacagctgcctcaaaccctttatctctcctcactcaccctaaacccaaacagcctcttattagttccaaacaattcatactgtcattgacaagtcctctagaaatgagggggaagaagttctggttactttgtcctttagctcagtatttcttaaactggtctataaaccatctgaatggtttagtggagtcttacacacacacgcctactcaatcagaaagtctgtggaaaggacctctgatctcttaagatttttcagaaattgtctattctagactgctccctcttctctttttattttgatgtttagtttccaaatccatgtcccctatacctataccccaccagccacttctaaaccactgataatctttagctattggtgagtgcctttttctcttttctgcccatcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggttgagggggttctttccccgggcggtttggggtattggagtgaggtcaggggcgtgcccttggagtgcgcggccgctgtgacctctggccccttacccacattttactttctgccctgtgacctctgatccctgccctctcctccccgtgcccggtccggcgtgttctgtcctacctca

SEQ ID NO: 15062 - DNA, 2468 bp, Homo sapiens; identical to SEQ ID NO: 15061

SEQ ID NO: 15063 - DNA, 1102 bp, Homo sapiens
ggaagcagccttcccaagatcttcactatggatttccttggcagagctcactgtagcctgtctccagggacttcaccctgccttttctgggcagccccattcttgtctctctgggtttccctgaaaatcttgagaaataccaaagagatattcaccacccttctgcctatgtttaccatttgttgcttcccccagttcctctcatacagcaaaagggttgcagcttcatgccctgtgtttggttccccacatctaggcagtgacgaagatccgagagtttatcctccagaagatttattccttcaggaaacccatgaccaactatcagatcccccagacggccctgctgaagtacaggtcacaaccccaaggaagtgcatgggatggcctttgagtttttgagcggcctagtgtgggcatctggtttcttgggagacaggtagactgacatgttcctgaccccctaggttcttctatcagtttctgctgggcaatgaacgagcaacagcaaaggagatcagggatgaatatgtggagacgctgagcaagatttacctgtcttactaccgctcttacctggggcggctcatgaaggtgcaggtaaggtcaggagggagaggtattcctgggcacatggactgggaggaggggacatccctgggcaaggaatattttattgtgttgtgggaagagacggttatcagttctcttttctctttccttagtatgaggaagtcgctgagaaagatgatctaatgggtgtggaagatacagcaaagaaagatatcctagtactggggaaccctcatgccaggccttgagagtgggaggactttcgactccagccaccaatgcactgctccttaccttttcctatgggactgaaaccttttagaatgtgatgaaagctatagcctccctccccagaaagatgcacacattattttgacacatagttttgcatatgattgcaagggagggagagacaccctgaagcccattcacagatgtcagcacgtggggccctagtactgggaaagagggctggctaggccacgtctgcctgtctggggtccccacagatagtgagtctttgggccca

SEQ ID NO: 15064 - DNA, 1616 bp, Homo sapiens
tgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggcttcctgtcctttctgtccattctaatagggaatgttaaagtgctgggtcctttttccatttagagctgccctactcagttgcccacacagtgctattagttttagcagtggtgatgctgcagaccccccagtctccctatatgtagctagtgatgtccctctctgtaaagagaaatgtgagggtaaaacagttcagccttgaggggctgacccagaccagtttagagaccaacaccctggggttggtgtgcagcatcattgtggagtgggttagctgagcctagccagttgcagttaaggtgagtttgcaggtcttggtcactctgggtttttttgtttttgtttttgttttcttttaaggggtcatctagtcataagggaaaatccttcgggctgtgaccgaagcaacaaaggcaaaaacgcggacgttggttatgaagggtgtggtctccctggtggagtacgtcggtgggttgggatg

SEQ ID NO: 15065 - DNA, 1114 bp, Homo sapiens
agctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttcttcgagtgcagtgtggtcttcaccaggacccccagaacaccacaaacctggagagcccagaggctgccagaccctgctgcatgggaaggacatctccagggacatgggagagaggacagcctctctgaggaggaaggcccctaaaaggcaaagctaaggccacagcagccacaaggtatggggtgggggtagaggcaggacactgacccctccgatcctagaatggcctcatgcttggcaagggggaggggaacaggtccacaagatgat

SEQ ID NO: 15066 - DNA, 1100 bp, Homo sapiens
tggtgcttggagatagagtggttcaggttgtgtcagaagtggcctcggattctgcagtcccccgagctagagtgtgctatgtgttcagagtaggcttcaaaggccataccccctcattgcccctactcaccacccctagacctctctgctcaccctcagccacactaggtgccacccagtcgcagagcaaaaggagtttgcagggagggctaggaaatggtgagtatcagaaaaggtgtcctctgaggggtgggtaaactgcagtttagccctccccaataactgcatttctctatttttttctccttctttctctccctcatgcccctcccaacccctcatctccctgtcttcctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacagtgagttgggggacagaggtctccaggggtagagggtgggcactggattgtggggaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctct

SEQ ID NO: 15067 - DNA, 1197 bp, Homo sapiens
ttctgagctttagtttcctcatctgtcaaatggggttgagaggaatacctacctcactgttgtggggagttacacagataatgagcgtgaacatatttttgagttgtaacgggctgtgtcgttatgagatgttatcattattcttttctctttttcttcccagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggagga

SEQ ID NO: 15068 - DNA, 1099 bp, Homo sapiens
aagaggaagaagcagcagcaggtatgtcaagggaacattctcctcacctgtcatttctgttttgttaggcatgagccacctgtttgaaacctttcccttcctcctcctagtgtcctctcagcagtattttttccccctcattctcaggctaccctctccccttttcttcttttccaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacaggtaataacaagaggaggaggaagagggaagccaaggagggattgcaggggactttcggagagcaatactggggaactgagtctgctgggagagactggactgcccccctccagcctcagtcttcccgtacccctccacatatttatgtttctgtttctagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaaggtaagaaggggagggcgtgtttcctctgacaatttgttctctttcattggctgtttcagctgct

SEQ ID NO: 15069 - DNA, 1198 bp, Homo sapiens
gggtcgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatggtgagaaacatttcccccacccaacaaaatatccccaatccctgacccctttagcccttacccctcttctgagaaactgaactcaatcccactccttgattcaaccatgtttatc

SEQ ID NO: 15070 - DNA, 1271 bp, Homo sapiens
accagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagat

SEQ ID NO: 15071 - DNA, 1485 bp, Homo sapiens
gtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggg

SEQ ID NO: 15072 - DNA, 1135 bp, Homo sapiens
gcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccat

SEQ ID NO: 15073 - DNA, 1309 bp, Homo sapiens
cttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctgacttagtttttgtattctctgctacccctctttccatcaggccagactgtgggaacctgggcacgcctggcatacatctggcttattactgaataaaacctcacactaggcctctagaatcccatagaggcctgagtatggttctgcagcccccactccgatggaaggcgttcgcccctccccatgaacttctctcatctcgttgggtttcatgcagtttccaccctttaggaagtctgggaggtcctttagctacagagctggtggagcagctgcacatatctgaggacccccacaggctacctctgac

SEQ ID NO: 15074 - DNA, 1203 bp, Homo sapiens
aagtttgtttttttttttttagaaacgaggatccaattaaggttttttcattccattctgttgctctgtcactttggtctctgtttcagaacaatttttcacctctccacccagccccagcctttaaaacatttttgtaattatgtaacattttactttgacaaggcaggcctgtgtctcatctcttaagctctggccacagcggtccggcctgccttttctcttagccttagaccctgagctgccgagaccctctgctcctcccccaggccccagatctgagctgggattagaatccgcatcagggagggataggctggggtcagcttcgggattccaacaaggagtagggagagctggggctgaggatggctgggctggggttgtggtccagcttagaatcagctcgaagctgatgtccgggctggctttagggcagagtcagttgggactcagggatgactcctgggatgacttaggggtacagacaggtgttggggaatcagtcctcaccctctgtattcccccaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggtgcgccgctgccctgctggcccactcgctggctgcacgttccttcctcagcaagcgatttcctcaggcacatgtgctgtgccaggcactgttttggggcctagggtccagtagggcaccagacagcagggccgggttcatgggaatgggacctggcccggtgctcacaagggccttgcactgggttagatgctctgctgctgagcaagggtcctgctctttcattctgcactgggccctacaagttatgtagccaatccttccacacaaacaaggtccctgccctcgtggaggtttcgctctggtgggaaacagcccacaagctaaataactatgtaatgtaagccactcttctgcccagcgatgcttcctttcctggacctctgcctttctagggtattgggtccttacctcggggtttgggggcagcgttccagagcagagctgggcccttggcccacctgtgactctctgtgacccccagcctgtctgcccccccaggagcacattg

SEQ ID NO: 15075 - DNA, 1191 bp, Homo sapiens
accccctccccggccggcgcctgctcctccctcctcccttgcctgggtagaaactctgctggttgtgtgaactattcctgcacctgttggtaactgccaccctgaatagcactgggtggctcagcactgggaggccctagcctccctagcccttctctgggatcccctaaaatttggcccactctggcaacaatgggaatgactccttgtaccactagaggcccccaagaccttctccagtgacaaagtcagaacctgtattgaaccagttgttaaatattttgaatatcacctcggcccttgcgcttcctcaccctgtccgtctgaacccccatctagccttcccggaccccagggtgatgccctggggctttccctccttggggagctgggagtccatcccacccatctctaagccttgggagggagctagttccagggtggcggtgctgccagctggggaaggggaagggtgggctctgtccttagagggaccagcctctgagaccctcttcccaccgctggctgtcaccaccccaggttcctggactacctctctgacctgtgtgtgtccaaccacatcgccatccccgtcacccaagagctcatctgcaagtgtgtgctggaccccaagaacagtgacattctcatccggaccgagtgagccctgtgccccctgcccgcacttgggctccacgctgctgacccccagctgtcttagagcttaggccctgtctgggttcaggctggaactggcacccttgctctctgcagctgtgaactctgtgcctgttatgtgccccgctgtgtgcctggcactgtgggggagtggggaaggggcacagaaaagaatgagccacggaccctgcccttgagatgcatatggtctctctgggtccccgtggtggctggcactgtgtggccgggtgtgctcagggaggggtccaggcgtagtgccctggacctggctccctgtgacaggttgctggtggtctgcaggcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtgccccgc

SEQ ID NO: 15076 - DNA, 1279 bp, Homo sapiens
ctccagagcccccaggaagtcatgtctgtgaggaggaggcagagggcctggtattgccagggcagcacagagcttcccacgttcctcattttggtatcccctctatcaaggttgcacccctttcaccacctccccacctccccctcctccctctcccatcttgccctcaccctccctggccaaggctggctcttctcatctcactgccctcccctgtctcccaccctttccctcatctttcagacgtccctcttcccatgaagacctgtcctggctgagccttagccaggagggggagaattgcaagtactggttatcacagacaggttttccgttcacctttctaactcagaattgcagctggcgcatctttaacctaatccctttgccactttactgagtcctcaccaagtctagtgcccagtgccagcagcctcccggctgccatctgccgtgtcctcacagtcctccctgtcctgcaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggagtgagaggggtggaggcagggtgggcggggcaggggcagaggctggagtgggtgtatctcggggaccttcatgcctcatggcctccaccctcagctatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggctgggggagtgcccaggggctgggggtccgtggagctcttgttggccccacactggcctcggtcttcacccaggagtcggctgtgggatccatgaccccacttccttctgtgtccccagccagtgcagggggaccgcatagaaggctgggattctccaagaggcaggctcctgttccaatgcctgggaaagggctgcctctccctgctccgctctccctcctgggaaccccgtcctcatgacgcccctttcgccctagtttccccagtcctggcctgccctccacgaagccccgcccctacg

SEQ ID NO: 15077 - DNA, 1105 bp, Homo sapiens
gcagcgcttacctcaccaggctcccgtctgcttctcctcttggcttctggggacgtctagctaacaccagtctgcctcgctcttttctggaacacactgagtgggtgggagagccttgggtctctggcccctaaggaaccccttgcttgagggctggagtcccttgaactgtcattcatgttaaacccagtatttgcagaaactgcccgtgtgccaggcctaggggtacagagacccctccctgcccttagtgtgcaacccagtcgggggcagaagcgtgatgacccttcactgtggctggacagtggagggctggcgatccaggaccagggaaggtttcctggaggatgtgacactggggacagagccaggggataaggccaggcactggacctcctgatgatctcatccatatcccctccagccagccccctggggatgccacatggagctgctgcatttgtggacacctgcagtggggacaagatggactgtgtctcagggctctcggtgcctgaggtcctggaaggtgagggtggtgtgtgtgcaggagtctgtgtggggtaggaggagcaggcagcccgggcctcagcacactctccgcttgcagaggacagggagctggacagcacagagcgggcctgtgacactctgttgatgtgcatcgtcactgtcatgaaccatgggctacgcaacggtggtggcgtgggcgacattctccgcaagccctccaaagatgtgagcactcctgcccactcccaaacctgtggggcccaagccactgtccagatcagcaactgtggagagtcctgtccttggcctcgcgtcagatattcagggttgaaccccctcccccgaacttgtatccacttttccctgctttccacacctggccaattccatgatattactgcttagctgccccctcaccctcccattccataaggaaagactttggcaaccaaactttgccccagggctagggatggtgaccactggctttcctagcccacagcaggtgggcagagggcggagctgagtcagctttatcaggaggcctcatgatttggcttgggcagccacattcccgaatgtcaggccttcc

SEQ ID NO: 15078 - DNA, 1245 bp, Homo sapiens
ggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaagggatgtgtttcctgcactcccccgggggctgtggggattaacaggacacactggcagaagacaggaacaagagcccctccctgctggcctggcctctcaggctctcaggagatacgctgagtgacatcctgtctcaagggtcctcccctgagatttgcctacccagaactgcatttcggcataactggtttctacggcagtcctgtcgattttattttatgcatttcagaacatcctgaggagtctagacacagacgaggttaagaacccacttccactttgtacccaccagggccgctgtgggcccagccctgtccctcacggttccagagagaaggatgctcaatatcagtaagagccaaggttccatggaataatgaggtgaccctgtgtgtgtcctcag

SEQ ID NO: 15079 - DNA, 1221 bp, Homo sapiens
tctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttg

SEQ ID NO: 15080 - DNA, 1257 bp, Homo sapiens
gtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtgcctctctccttccagccaggaagtcctcttcttgagaagttagcttcccgggctgccagcactcatagccgtcccctcctgcttgtgttggctccaggctcgggtgctaagaagatgtgtgtctgtcctggagatcagtgtgttgttatgtgtccacgtgggcccacaagtgcacggcacaggcatggccgtgt

SEQ ID NO: 15081 - DNA, 1166 bp, Homo sapiens
tcatatgagtcttgagagtttcgggttcagtcaggattccctgtaggtcaattatgtctgagttatgccggagaccttttttaactccagctgttagattcagtaagtccctgtggggtccgggcagctggacttttagccaactagctgggtgatttgagtgtggggctacaaggtgccaccacccagtaggatggtccggggcaccgggtggcatgttctgaggcctgctttacggtgctgtcattgccagatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttg

SEQ ID NO: 15082 - DNA, 1267 bp, Homo sapiens
tggacagctgctctccccgggctgggccaccagcatgggaaccaggaggtctgggttccacccagtccttcacacttggctctcccagccacccctctgttccttagggtgacacaagctagcccctggatctatttcctggttaggggcatgacttctagtaaaaactctgtcattgctacagggttatttttaggtttaaatatagaaataaagattggagactcgacctgattcctaagcttgtggagggtgattgcttctcaggtatcactcactgcctcttttcagtgcctgacctcggtgcagccgagggatggaagtctccccaccaaccacagttatattcatgcggtgcagtttggatgttgattgggctaagccagtggcccctgctttccagggcagtgctgggttgttgaggggacaggaagagggaggagagaggaagaagcagtattagtggcgaaggccaaaatagtaacagctgcaaacaaagacacttgcccacttgggtcttgtgctggaaaactagagatggcggcatgtagggatggggaggagaggcctgggggtctgcatggttggggcttgctggatggaggagatccaggcaagcgtgagcctggtggctggtcccctggctctgggagaggaggaaggtcagggtggggtattttctaggctgagcagggaggcccaagggctgatgagatgtgcttgccttgtcgatgggacttgctgctgtgagctgctgtggcctttgcacgtggctgtccttctaagtctcaggtttctctggtgatgagtccctgcctgtgctgtgctcaaacccttctgtggcccctcatttccctgtccacaccgtggtcgataaggtcctgttgatcttgtgttccaggccctctctgacttcatcgcatcaaccctctccccactgccccctggtcacgttggcctccttgctcattctcgaacatcaagtgccaagcctgtgcccacctcagggcctttgcacttgctgttctttctctttggaatcctcttctcccagatgttcacatggctcatgccttcactgcttttactctaggatcaaatgccacttccccagagaagccttccctgattattcttttctgaaaaagcccttctgggtcattccctgtccccttatctgccttattttttttcatatcgcctgatcccctgaagtcccagccatctatatgttcaggtatttgttgttcgtcctgtgcccacccgc

SEQ ID NO: 15083 - DNA, 1168 bp, Homo sapiens
gccagatcgcaaggtctcattctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctgggaccccccccaccacgctgcactggggcggtgttaaggcaggacaacaaagagcccttctgaacaggagatagataagaagctgattagggccaacggcccttccccgcccttggcagcatctgggggtgggcagacccctccatcctgggcagagtaggaggcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcaggtgggtgtccaaacctttgcttcacttggtttaccctttggggctagggaggtgcctggagtttcattcagcaggcgagaccatgcatggagggtgcagaatgattctgcgcagtaagcgtgtgggtgtgtcctcccacctgtgtgtactcctgccccacttgcaaccctggtcagatctctatagagaccccaggagagaaccgggggccgaggaattcaagataaattctgaagccaatggcaaacagtccaaacctaaagcaccccagaggtcacatggccagtgcttaaaacactcgcctttttcttaatttccaatccactgtggaccagtaattttaaaatgcagtaaagacgaatgaacaaaaatgaacatagaagcccagggtttttaatcattagattcagtgcacgtaaaatgatttttgtcaatttgctgtaaagttgctgaatacttatggtcgattcttgtacttcctcatcccaggtgagaaacgggtgcctgcgtgggcca

SEQ ID NO: 15084 - DNA, 1205 bp, Homo sapiens
gctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctggactggagtctcctgtggtgtgtgcccctaaagcctggggcaggtaggatgggtgacacttgtgttctggcccccatccttcaggctgcaggaagggaggggaaatagcactggaatcacctccggggaaggtcattttaagcctcttgatgaaatcaaaacccctagccacaaaacattttatttacaaaatatatactgaatactatacatctggccccatcaccatggaaacaact

SEQ ID NO: 15085 - DNA, 1438 bp, Homo sapiens
taatttgtcaaaaattaaaaattttaaatagtaactaaataaaataatgctgctacaggccaggcgccatggtgcacgcctgtaatcccagcactttgggagtccaaggtgggaggatcacttgaatccaagagttctagactggcttaggcaatatagtgagacttcacctctacaattttttttttttaattagccaagcatggtggcacacacctgtaatcccacctactcaaggaagtgaagatgggaggatcacatgagcccaggccgcgaaggctgcagtgagccaagacagcgccactgcattccagcctgagtgacagagtgagaccctgtctcaaaaaataataatctgctataaatatttttgtacacatttgttgaagacatatattttcatttttttctgggcatgtacttgccgtatcattaggtaagtttatatttgaatctacgctctttccctcggagcgggcggcgcggcggcgtcggcggcctgtgcagcaatggccaagatcaaggctcgagatcttcgcgggaagaaggaggagctgctgaaacagctggacgacctgaaggtggagctgtcccagctgcgcgtcgccaaagtgacaggcggtgcggcctccaagctctctaagatccgagtcgtccgcaaatccattgcctgtgttctcactgttattaactagactcagaaagaaaacctcaggaaattctacaagggcaggaactacaagcccctggacctgcggcctaagaagacacgcgccatgcgccgccggctcaacaagcatgaggagaacccgaagaccaagaagcagcagcggaaggagcggctgtacccgctggggaagtacgcggtcaaggcctgaggagcgcattgtccataaagcacgcctggctgagaaaaaaaaaaaaaatctataagaaaattctaaacagttttccaaagtggttgtaccatgccacaccactaccagtgatgcatgagaatttcagttgtgccatattctcttaaaaattaaatatctttcttttttaaaaactatttctgcccccaactctgccaatacttgcttcatatattatgggactctgttgttcaacatgtatgttattatacttgccgtatcttcttgatgaattgactcctttatcattataaaatgtcttcctttatcttgtgtaacacttttttacttaaaatcgattttgtctaatattagtatagccatttttgctctctttacactcttcatgggatacctttcccatccttccactttcaatttatttgtgtctttgagtctaaagtaagtttcttttttttttttttttttgaggcagagtcttgctctgtcacccaggctggagtgcagtggcgctatctcggctcactgcaagctccacctcccgggttcacgccattctc

SEQ ID NO: 15086 - DNA, 1857 bp, Homo sapiens
tctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaa

SEQ ID NO: 15087 - DNA, 1857 bp, Homo sapiens; identical to SEQ ID NO: 15086

SEQ ID NO: 15088 - DNA, 2596 bp, Homo sapiens
ggaaagctttgtgacctgggtggaggaaggttggcattgactgatctaccatctgaaagatgggggagttatctctaccctcccctctctttggatgatgtgagaaatctttggattcagtgagaaacttagcaacttgaaatgtactgatctttggcctgccgaggttttgtatggcaaagaccctcaggccttgtctgtggattggggcttccttgtgactcactgggaaccatagatcttgcacttggtttggttgtcaagttgcactgctatgtgtaccatcactgactatcttcactctcttccaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctg

SEQ ID NO: 15089 - DNA, 1561 bp, Homo sapiens
tgagctcaggagttcaagacaagcctggacaacacagtgagacctcttggctacaaataataaaaaaaactagctgggcatggtgacacatgtctgtggtcccaggtacccaggaggctgagggtaggggaattccttgagcccaggcagttgaggctgcagtgagctgtgatcccgccactgcactccagcttgggcaacagagtgagatcatgtctcaaaaaaagagaaaaaaatcctaaaaacaaaaaacaaaaacaaatgtggtggtgtgactgtagttccagctgctgctcttagggaggctgaggcaggacgattgcttgagcccaggagttcaaggttacagtgaaccatgatcatgccactacaccccagcctgggcaagagaatgagaccctgcctctaaatcagtacatgaataaaaataaaaagtcaggtttagcttttccagccccggccccggcccctgcagccgcagagatgttgatgcctaagaagaaccggattgccatttatgaactcctttttaagaagggagtcatggtggccaagaaggatgtccacatgcctaagcacccggagctggcagacaagaatgtgcccaaccttcatgtcatgaaagccatgcagtctctctagtcccgaggctacgtgaaggaacagtttgcctggagacatttctactggtaccttaccaatgagggtatccagtatctccatgattaccttcatctgcccccggagattgtgcctgccaccctacgccgtaggcatccagagactggcaggcctcggcctaaaggtctggagggtgagcaacctgcgagactcacaagatgggaagctgacagagatacctacagacagagtgctgtgccacctggtgccgacaagaaagccgagtctggggctgggtcagcaactgaattccagtttagaggcggatttggttgtggacatagtcagctacctcagtaaaattggagaggattcttttgcgttgaataaacttacaaccaaaaagaaaaaaaaaagtcaggtttaatgagggtataatttacatacaataagatacacctgccaggtgtggtggctcactcctataatcctagcactttgggaggctgaggcaggaggatcacttgaggctaggagttcaagatcagcctgggcaacataaaaatcccatcttaaaaaaaaaaagttaaaaaaaaagacataaaatatataccttttaggggagctatcccttttatgtggaaggcgttccagctgggggctacatgttggtgatttgaagtctctatgtgaaaaaaatgagcttcagccattgcagcaaaggagttacttggggcaggttgcactcgggtctggactgtggcggtctcaggtgtacaggcagtgtattcaatggaaagtgggtaagcgctggactctatttgggctcaaattctctttttcccacatattaactatgcaatcttgttcagattatatcatctccttcagtctcagtttccttatcagtaaaaaaagcttcaaaatcaaatcccatcag

SEQ ID NO: 15090 - DNA, 1037 bp, Homo sapiens
atttaatctttcccctctataatacaacttacttgaaatttaaatcaagaaaaaatttctgacgctgagctaggttggtggcatgatatgccaggggtcagtgggggagcttgcttctgagccccctgttgtccgcctggagtcctgcttgtctttcccagctgtgctgagtggctcttctgtctccctggggtccctggcacatctgctttcccagctctgtgaccttaccagttctctcctcagcccttggtggtttgggagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaactaattgatcacaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtg

SEQ ID NO: 15091 - DNA, 1281 bp, Homo sapiens
ggagatcacgagttcaggagatcgagaccatcctggccaacatggtgaaactttgtttccactaaaaatacaaaaattagctgggtgtggtggtgggtgcctgtagttccagccactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatgg

SEQ ID NO: 15092 - DNA, 1221 bp, Homo sapiens
gggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattatt

SEQ ID NO: 15093 - DNA, 1206 bp, Homo sapiens
accatattggtcagggtggtctcgaactcttggccgcaggtgatccatctgcctcggcctcctaaagtgctgggattacaggcatgagccactgcgcccagcccatgtctgcatcttacttgttaacacgctgaggaaagtctggacatggagatttatggaggatgagaccaagtctcaaccacagtatacttttcaacaaatattgctaattggagttaaagtgttcgttaatgtgaaaataaaattactttggattgagactgctgctggagactgctgtagaagaaaaattagacaaaatgctctctataaagcctctattttaagaagaatgattcagagaggaacataggtccaagaaattttcatcaacaaatgaaaactgaactgccaggtttgccagatgtcttattttaaggaaatttttcctcatttggtctcttgtaaaagtcttccttttgcctctgaaatataccctgtccctatgtaacttaaaaataaaattttcagagtgttcaaagttccttctgtgtaggatttgtaattctgtgtaattcagctgggaattgtattgcataaaaataaaggcaaaaaataaccacattgttggattacagagttttgggaaatttccttaatttatttagtatagtccatcgtggtctgtcactcagcatttgttgagtgcctgctgtgaacagacaccgctacttgttctttaaggcggcagcaatgtgccttaatgtggttgtcctcattaatgttctaccctatggtcgtcctaccttacatggtataatagagtagaatggctgatatttaagggagggcctctcccctttatttagacacacaagtcctgggcatctctcttttggggacaacataaaacacccctgcctagtcctttatttggtccaccactaatcctatcccagcatcctgtgtaggcctccatggggcctacatactctgtcaggggaagagccaggagagaaggaagaaggctttgaagagccagccccagcagcctgctgacagttttccttctctccccactgtggaaggactgactaccagtggagaggtggcagcaggcttttggctaagtggagaggctctctcttcctgtgtagtttgtggagaggcagcgttgactcaaggtacagttagaagtcagcgatgctttcttttgggactttc

SEQ ID NO: 15094 - DNA, 1285 bp, Homo sapiens
ccttcacgatggagcatggctaagagctgcttggcaagtattagcctcagaaaagagattatgcagaacactgtaggcatgggagacgcaagaaaggaaggatcctggattttatttagcattttttgaagactaaaatcaaagaaaagggagttttttgtttttttgtttttgtttttccttagagacaggatcttgttctgtcacccaggctggagttctgtggcacaatcctggttcactgcagcctcaaacttctgggctcaagtgatcctcagaaaggggtgtattctaatcaaaggcctttcagattggaggtatggatatatatccagaaatgcagttgtgattctatgtgacacttgaattattcaccttctcttttccacctttcttctttgatgaaaaaagagccaataatctcgaatttgttccagactgcctgtcttggtattagccacatgcacaagatacactggatgtttctctcccttaggttctgtccatgagacctaggattcatgggagtgcagcccgggaagaagacgaacacccttatgaactgttgttaacagcagagacaaagaaagtggtgttggtggatggaaaaacaaaaggtacgttccccacaactcctggcagaaccaactccaaagggatttttaaagtttgtgatcctgagtggaaggggaagatgtcgtaactatgatattccttgggttgtggtggttgggtttcacgatgatctgggatggtgggtccattatggcttttcatttccaatacctgacctatatgctctaggttggagttggctgccaccttcagtatgcgaagcaaggaaaaggttaggtcagactaggtgctaactgtgggaggagagaccaccagccccacggcagagattgatttggggtctcaaatcataaaccctcaagttaatgctgtggaaaaacaagctcaacaagtcagtccctttgggttcaggctgacggcacagactctgcttttgagtcctgacctcagagtgagacactcctggggaggggcccgtgattggctgccaccctgtaactagagtgctctgtcgccttggcctactttcattgcctctgcaaaattcagtttcctctgtaagggagtgagtgctgcagtactgagatccagcccgtcgatataagtgcagtcacgacagaggtgagtgtgcactgctggagaatttgtgtcaacccctgttctaaggaagaatgataagggacaatgcagttcccactgcagtttgaag

SEQ ID NO: 15095 - DNA, 1191 bp, Homo sapiens
gttttgtttctgttaaggaattccagaagttgcaggttgtggatcatgacctcttttttttttttttttttttttctgttgctgcttgccagaggaagggagggcgggtggcctttaaataacactttggcctttatggaaatgtatcagatgttccaggagtgggtctccctgctcgcgcttgctcactggtgctcttacttttgcttcatgttcactcactctgtcctgacttgtgtcctttctctaggttatacttaacactcttctcgccttatatagcaaggtctggtcgttaatgttaacagaaatctaacaacagggaaggctgccagatagcattaatcaggccagtgtttggaatttcataaatgctctgactttgggtacaaattgaacattaagaacaatatgaaaactgtcttccttcctctctcttcttctctcctctccccctccccagcctatccagtttctctctctgtttctctgtgaattcctctgctttgccatatgcttgctgcattggaactttgttgatttttgccacgtttaattttttatttctctgtctctccgtccactccaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgaggtaaggccgacatg

SEQ ID NO: 15096 - DNA, 2766 bp, Homo sapiens
aaccccgacgggcagggcagtctccagcaggatcccaacggcactgatagctccccagggttgggctgggctctgtgtggctccctcctcctgtctgctgtactgagccacagctgggcaccgttgccaagagctagctgactgttctcacctctcctgaaccaaccaaccactgtgaccacccagtgccagagtccccagcactctgctcacagccggcctgcagccccaccccactgtcctccgctactccgaggtgctggcctcactctcatggctaggcccttgtgagaccttgagctcagtgatgtggctggaccagggacagactgctttctgtgagggcccaagatatgcgccaggcccttgggtccgtgctgactgccccacttggggctctgggtatctgaacactcacaggctggctcacacagcaggtgtctcagtcctgatgggccttcccctccaaggaggtgggtggcatgtgtgtggacagcccctctatcttcgccatggagtctcaaggcctggcagccttgggcctggctctggagtctagctcactgaggaggaaggccttccgtagaaccaacgaggaggcggcctgtgccctgcacacacggcgcaccttcttccctcacagaacagagctgctggaggacagggacctggaccaagtggcctccattgtcctctgggagctttctgacactctccacggtgggggatcacagatagacagcgccgtccagcatgcccctgaccacctccctcagcctcctgactcctccgaaaggagaggccgtcccatcgcagcagctcagaagctgggatggtggagctgagtctttgaagaggcaccccattctccagtgtgggcaaatcagtttggatggcaggagacaggaaggaagcggcgcccataggcagccgtgcacacatagcagagtccactaggaaagccagtcggccagggcagtcaaaacccaagtcgataaactgggtgggtcctgcgtacccacccatccttgtgccttcctgagcagagtcactgagccagaggcagtgggggctgcaggctgtgggtgctcaaagcaggcatggagggtgccccggggaggctgtgagggatcgtctgtcctgctctgtgtttcctttccatttcctccaccgtccgcaggccccattggttaaccctttcctccccccattgtttgcttctgccaagctgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcgg

SEQ ID NO: 15097 - DNA, 1342 bp, Homo sapiens
gatttgctatacttgtaagcaagaaagaggattcaaggatggctccaaggattggggcctaagcaacagaaggatggagctgccactgattcagttgtggaattccagaataagggcagatggtgggaatgggaatccagagttgccctctggatatattcagtataggatgcctagtagacatcaagaagggctgctgagtcatggtgtttctctttcccacccccgacggtgaggctgacattgctccctgccatcctttgcaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctg

SEQ ID NO: 15098 - DNA, 1726 bp, Homo sapiens
tttttttttgagatggagtctcgctctgtcacccaggctggagtgtaatggtgctatctcggcctactgcaacctccgcctcccaggctcaagcaattctgcctcggcctcccaagtagctgggattacaggcatgcgccaccgcgcccagctaatttttgtatttttagtagagatggggtttcaccatgttgcccgggctggtcttgaactcttgacctcaggtgatccacccgcctcagtctcccaaagtgctgggattacaggcatgagccaccgcgcccagcctaggataactttctgattcctctctgccagccgttttgcgtctcttggaaagccaaacggtgaccatgcttcttaatttatgccttcagggtctggcttctcctttctcccttcctttcctgtcacaccatgcatacatacatacaaatacacatccttcaaccatttattccatggcttatgagacctgcaaatgagttccacagtacggaaggcatagaccactaggcttcttaattgatgtcaaggcagatcttggtgagcaggtaaaaacctgctattgtccaccaagtttaatttaggtcctccaagttggagggttaagaacccaggcaaagctgctgctgaatctatggaggaggctggccctgggacatcaaactaggggttaactggattgaatgaggagtcaacgctcagggacattctaggtctttacaggtcagacagaagagaggtttttaccattggagggaaatggaaagatggtataaataggatcccttcatgaagcaacccagaggcctctctgcagcgtgtagggtgtggggcgacagtattgtggggcttccattcatcttagtacaaaacctcacctgctctgagcctggaaatgggagggcttcacgcaccaagtaatgcacaccagaaaggcacttatatcctcagcaacatggcagttcctctttacttctctgcctccctctttctatattatcaggccatgcctattcctacaacctgagacaactcttggagtcagaagaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggaatagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatatt

SEQ ID NO: 15099 - DNA, 1206 bp, Homo sapiens
gagatgaccatatttttatatcttatttaattatataatgttgtttaattacatgttatataattatgattaaggttggtactaggaaggaaataacttgagcccgtttcccccacgtggcatctgttcaccgaccattatctgttccagtcaggctctcagaaaggggtcagatcaggaaaccccaacatgaaggagttccccagaccctcacccctaggcagcttagcaacatgcccaccccctcctcctccgcccccacgtgccccttttgacctggctcttggtccaccacctcccccctccacaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccaggtaggcctgaggaacctcttctggttctctcaccacccctcctggaacacaccccagttttcctgcttgctgtgcacctgcaaggtgccttggcactagaggctacacagtacacactcacccggcagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggtgaggcctggggtgggatggggtggaggctggcagggtgagctcattagggcacaggctctggagccaggctgccttccctcaaaccctggccctagcagctgctggctgtgtgactttggacaaatgcccaaacttcttggagttagtctctcacctgggaaactggtaatagcgttgttatgaagattaaatgagatgatacatgatacttagtacgtagtaagtgctgaagaaacatttgctgctatctttgttcacatcattattaatctggggaaaaatttttccttctacccttccaagcccctgtcttgctatccttgtactttggctctactccttggagctttaatctccataaattcaaacacagaaatatggaacatagaaagggaaaat

SEQ ID NO: 15100 - DNA, 1180 bp, Homo sapiens
tatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccg

SEQ ID NO: 15101 - DNA, 1335 bp, Homo sapiens
cacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccattt

SEQ ID NO: 15102 - DNA, 1157 bp, Homo sapiens
cctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacaggccatctgctattcgtccaccaacctgacttgatcctctcttccctcctcccaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctctgtctgcctgtgattgagggtggggggtggtttgtcagctgacaagtgagggccttggcactgctgatggctagttgtgtagtttgtcactttgatgatggatagttgggtactatagggaagaggatgtttttctgccatcaaaatcaggcagtcttgcatatgtgatagggttgctaacggcattgaagctttttgacaggattggtccatgtaaatttaaaataaggattttagtcagcatttctgtgttaagaagaccacatgtggagtatcctatgctttgggttagtaatgagtaaatgttaaggaaaacaaggcacagcaaaccagtacaaaagtataattaatggaccttgttttttttttttaaatggagtttgtagcccaggctggagcgcaatggtgcgatctcaatctgtgggtcccagttcaagcaattctgcctcggcctctcaaagtgctgggattacaggtgtg

SEQ ID NO: 15103 - DNA, 1838 bp, Homo sapiens
tctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctactaaaaatacaaaaattagccaggtgtgg

SEQ ID NO: 15104 - DNA, 1171 bp, Homo sapiens
ccctcagccggcaccgctgcgggcgggagccaaacttcgctttcgggtccgggcgccgggacaaccggaccccagggcgagccgagcgccgggacgccgcgggcgcggggcggattcgcccacctggcggggctgtgaaggggatggtggcggggtggccgcgctccgggtgtggacgggcggtccccgccttcacctgccgcctcgggacaagcgttggggaaccgcatcgccgctgtcggccgcttgtggaggagtccgcgcagcgccgtctaacaggtgatccgcgtcactcccaggccataccgaagcggctgaacgctgtgccagggctccttatgctcttctgttctgggacgtgaaaacgtcttccgccttattggtcgtccaaaaaggtgcaccggtcacagtataagagtcaaaaaccagtattaccaaaaagacactacgagcgtcagggtgcagagtggctttcttcgattaacgaaccggcaggaccatcgtagtctctaaaatcgggttctgcagtggtggcgaaagcgtagtaagtttcaagttgtaagcggagatgcagaattgtagatacccttcagtgtggttcaggacagtgtgttcagcgtttggccgccgttcagtaaattctgcatgaagcagtttgagctcgtggttttggatttacttttcaggagtatgttttccagtggaataaggcttactactgaatgggagctttctttgcctctctgagtgtagacaggagtgtttattttcattgtcttcccattttgttagattgtggacaagggaaaagttaaagcatattttggttaagtatttttaatagtctgggattctatccacctcctccataagggtttttactttagagaattataaagtaattctctaaagggagctgcttctcttggtgtttgaatcaaaagccaagaatcgacttgaaaaaaattcttattctggtgggaaatttttattgtcatactttcacttcaccattttctgtttgtctctcccccagctgacctctgcctgacagtctgcaattatggccctgaccaatttagagattctatacaaatgacatttttaaaacgagggttattaatactcattatttgtgagaaacactttatttagttacccagtttttttc

SEQ ID NO: 15105 - DNA, 2381 bp, Homo sapiens
ggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggaggaaaagattggttgagtatgcttttttaatttaaatatgcaatgaaagtgtacaaattgcacacttgccattttgtggggttcatagttttgcttctagttttaaattgggagtggggtagaattaacagccaaattaacatttttggaatactgtttttcagcattttttttttaattgtttttccctacatccaatagcactttcttccagaagatttgtcaggggtggttgtttttctcaaattataaatgcacggtacgtgcaaaattcagaagacttagaaatataagctcttattaaggcaatggcatgatgtattacacaggcttt

SEQ ID NO: 15106 - DNA, 1214 bp, Homo sapiens
ccattttaagggaagggtagccttcccttaaaaacttagaagtcgggccaggtgcggtggctcacgcttgtaatcccagcactttgggaggctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacacaatactgatagttacttatgctgatttctaatcttactattaacactagcagttcttactgattcatgaaaatgtgcagcaaatatgttatataatatgacaataga

SEQ ID NO: 15107 - DNA, 1391 bp, Homo sapiens
caatccctacccctccacccctaactctggctccaggcaactatggatctgcttctaacactatagattaggtttatcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccat

SEQ ID NO: 15108 - DNA, 1886 bp, Homo sapiens
tgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaa

SEQ ID NO: 15109 - DNA, 1125 bp, Homo sapiens
ttccaccctcctggaaactgttgtattgtttccttcttggaaaggtagacatattgtttgtttgtggagccatctcagctgggcatgaccctctgagggatcaaatatttggacagaagccgaaggaaatactggcagatgtttctaactcctagctgtggctttccctggggtgtggaggagggcaaggagagagtacctttgaagagcgggaacacagttccatgtggctttcctgagcgcgctccaactgcagcgcttactccgagctctgccagctgggcggcccgccacagggagactgggagccaggagcccagaggcccgtgtggtgatctggctggctgaggtggagttgagtttttgcacactggagggtgtctctatgacccctgttctgccctgaggtccctcctctgagctctgacctggggctgggtgggacccggcactgttccaagaacccctcatgccttccagctacctggtgatgcccttcatgcagacggatctgcagaagatcatggggatggagttcagtgaggagaagatccagtacctggtgtatcagatgctcaaaggccttaaggtgggtggggacttggaggctggcagaggggacgccttgctgtctagacctgaggtttggggaggctggagggagcgcactgttacaggtcggccagcctgaagtgcctggtgtggaagctgggccatggactcacccttctctctctcccacatagtacatccactctgctggggtcgtgcacagggtgagtgctttctctgccatggtcctcagaggcccctgtcccatccctgggtatggggttctctggcaatcaaggagtgggaaagttggagggaggggacactgcccaggagcacagaatgtggagttttcacacccagccacggcccaggaaggcctgctcaaaagagtcactgtgtcccaggggacttcatggggaattgctgcagacaaagtgagccctgagctgagtgtttcaggcttcaagaatcaggaacattttagagctgggtgggccctgagagaacacctagtccaaccctcattttacacatgaagaaactgaggcccagaaggggaaggggcctggc

SEQ ID NO: 15110 - DNA, 1883 bp, Homo sapiens
ttagataaagtggtcagagaaggtctcactgagaagtgttgttcacttgaagaaatgaaagactcaaaggaagtgaaggagcaagccatgtggatgcctgaggggcaagttgttcagacagagggaaaagccagtcctcttggtggatgcttgatcatatgggaggatgaatgggtgcataagggcatccaactcatagtctcctggccttctctccttaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggtaagcatgcccagaagggctccttagggactcatggtttcttcttgggttggtgttggccctgtgccaggccttcgctaaacacagttggacactatatcctcctccccgaatttaaactcttccttttgaccccaggctcacctggcctggtttgtggttttgattttgccctcagagtaatgtat

SEQ ID NO: 15111 - DNA, 1401 bp, Homo sapiens
aatcatactctttttttttttttaattgcatcttaaatttgaataggttgtacatgcccatagtaataaaaatcaaaaaggtacaaaagagtgtataatgaaagctagcactcccctccctggaacatcaactgctagcattttcttttatatctttccagaggtaatccatatgtatacaagccaaaacttgcatgaataattaagagagtgagtggagaagcctaatatgcacatgttcctctaaaccattcctttttttccagctaataatatatcttggagatccttctgtgctttttattggcttcccagtgtcccattatataggaatgctatcatttgcttagccagtcctctaaaagatggacgtttagattgttttcatttattatcgtaaccagtgttgcagtgagcaaccttatgcatagataattttatatccatagggagcctatctatagaagtggaattactgaattgaaggaagtgtgtgtttgtagttttcatggatactgcctgtccccattcacaaacgttatcagtgatagcctgtatcactgaatctcgcacatacataaccctgtagttttatgggccttgtctccttggataaaaggaataaagggcagggcaggacctgggggagaggcctggggtggtgcttaggtgggacaggtgcagagcaggctgttctctgagctcatctctgtccagccctgctatacaggggtgtgtgctccctggatgccctgtctttgaagtgtccatctaacacacaggctgcagggcttctcttccttcgttcctttacccaactgctttattttcccttagcatcagtttctttctcgtatgtgtgttgatgaatgcatgcctgtgtgtttcattgctttctgtaactgtcagttcccaaaaggtcaggctcatgtctaaatgaatttgtacagcatctcacacaaagccaggagtggattggcacactttgtgcttctggtggtgacatcttattcttacttttaaaaccacatgcttactaaaattacgccaaaggatattgacctcccatagttccatcactgtaacatgattgtcttcatttttctgtgttgccttctgtttatttcaggcacatttttaacaaaatgctgacccaaacacatgcacttttgtattctacttttttcaatttttttttgtactttcttcatgttgacacataatctttatatatctcatattattggaacagtgtatctaacaatgcattataatttacttaaccattctattgttaggcatttgggttgtttccggcttttagcattatatgtaatgtagtgaacccatatttttgtttaaaatccttttattcatctttaaagttatttttctcagaat

SEQ ID NO: 15112 - DNA, 1180 bp, Homo sapiens
ggctcagctggccccagagggcagcaggtgggcctttcttagcctatggacccttacaactctccaaacagagtaagggcccagagaaggacctagctgcaaaattgattccatgccattcccccacccgactcctgcatatcctgcttgctgtcctcacctgctaggttcttggtggcctcctgcatggagtcccccaatttgcttccctctgccctgtaccctctccctggctttgctggtcctggccaagtggggccacaggagcccgagccccctgtgagacccactactgcccagcctcttactgtgcttgcatttcaggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccaga

SEQ ID NO: 15113 - DNA, 1879 bp, Homo sapiens
ccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagtagttgctgtgttgtgtttaatcagtaggggcctacccctgtcttcccattccctacagcctcctcctcaacaggccaggaccattaagaaagtttcctagctagcgagggctgtatctttctttttttttttttcttttgagacagcgtctctgttgcccaggctggagtgtagtggcatgatcatagctcactgcagcctcgatttcctgggctcaagagatcctcctacctcatcctccccagtagctgggactacaggcacgtgccaccatggccagctgtttttttgttgttgttgcccaggctggcctcaaactcctggactcaagcaatcctcccgccttggcctcccaaagtgctaggattacaagtgggagccaccatgcccagcttctgtctatctcttggac

SEQ ID NO: 15114 - DNA, 1381 bp, Homo sapiens
agtcccttctagggacaagacctactaatctgaccaggaaggaaatgaacatgtaggtgactggggctgggaaagcatgggacagggactggtcacttcgcacatattttccatgctgtgattttgggagaaaactgatgtggttaggaaggagaaagtatggacaccagagtgagcacaatttgttagtcatgagaatggcctttttccattgcaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggc

SEQ ID NO: 15115 - DNA, 2097 bp, Homo sapiens
acaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagtagtggaaatacgtggtgtgatttattaaactgataagaacagatactgcatttgatcttagcaaaaaggctgagaggggattgtgatgtgatttaaagcagatagtggcatataacttagaggcagagtgctgatggctgcttttaacccctttgtccacaaaccattacaacgcctaatttcgagtgttaatttcaaaactgtatcaccatcttcatgcaaagtgcttttccatctcagggaagctgggactgacttttgttcttagggagctagtctcctgaatcactgtccatatgaagagacttctcttgccccgactgcatgtgcttcttccacccacctcagtgttgcagggcagtgggccctcccctcacagta

SEQ ID NO: 15116 - DNA, 1175 bp, Homo sapiens
aaattagtcggacgtggtggcacacaactgaggtcccagctactcaggaagctgagttgggaggattgcttgaacctgggaggtcgaggctgcagtgagccatgatcacgccattgtactccagtttgggtgacacagcaagaccatgtctcaaaaaaaaaaaaaaaaaaaaattctgaataccatatagaaacagaggaatatttgagtacaagaagtagtaaaattgtctctagatgctatggaggggtcagctatgtttaaaaatcagtatttggataaaaccaaagatgatatgcagaaatgaaaatagttttattagtataataggatttgggattaaaaaatttatctgcaattacatgatttttcctatcataaaagaaggagcagtgtactttggctgtagagctataatggatgctggaaggagcagaacgtaatgttctgttctacctccaagaatactcatccatctatcaccttgtttcttccccatagggccatgtgaaactttctgactttggtctttgcacaggactgaaaaaagcacataggacagaattttataggaatctgaaccacagcctccccagtgatttcagtaagtggtaacaattacgttagccttttcgttctaactgggcctagaagagctgtttcccttgtaaccaaattagaacagataggagattctcacactttgagtatgtagagaataaaaataccttcccaggtttgcctgtgatttgtgttgtctggtgaggcaagatgaatgagtgggtaccaagtgtgtgaaggcagaggttgaaaggggtctttagaggtctactgggaaggtcactggggatgagtatgggacaagcaagcagaagtagtagaggaaaaactcctgggaacagttctgggctagatttgtcctgggctagatttgtccttcatgacagaaagaagtttatctttatgacagtcacttccatttgagcactatgaaatcgttgacaactatgtagtaaaatttcagttcatcctagaaaagcatatgtcaaatcatgtatcataaattcagatgtccctgatcatataagttactactacttggaaaattgatggtaattttgagaaattgtgactgttttaggtccacgttaggacctcaattctagttgagactg

SEQ ID NO: 15117 - DNA, 1480 bp, Homo sapiens
gatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttata

SEQ ID NO: 15118 - DNA, 1111 bp, Homo sapiens
tggggggaaaacaaattgattttagctgataatacctggtggcaaacaggaccctggtccttgctcttgcaatagacttgcctttgttgacattagcttgcccttcagttgcctgctctcccagtgaccttggtgtgccaggctggctgagctctgctggtgggggtcaggcctcctgtgggaaggaagcaggaagaccagctggaaggagtgagagagaccctctggtaggaagacgtcacctgaggtgacacagcaaagcccggccaggtaacatagtgtctaatctccgccgtgaccagggccttccttgtatctctgctgcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacaggtgcggacatgtgcacggaaggactttgtaagggaccaggattctcagaatccatggtccaagggctgacctgtctggtcctggtccagcatgctccaggtagaaggaaacaggcccagagaggggaagcaacctccctgaggtcacacagcaagtaggcagcaaagaccaactagctaacatttattgggaatgttcattatgccaggccctttgccaagcttctaaggtagatttatttagtccttatagcaatgttataacataagacattcttgtcaccctgcccgcctttctttttgagacaggtgtcttaactctgttggccagactg

SEQ ID NO: 15119 - DNA, 1449 bp, Homo sapiens
aacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacct

SEQ ID NO: 15120 - DNA, 1821 bp, Homo sapiens
ttagtgaggagcatcaggggtcaaggctggggaataggtgaggacaaggaagatgaagtcgccagaatagtgtagtgatggcctttgtacagggcagagagactgccctgaggggttgtctgggtctggacagaggccagaacaaagtcctggctgctttttcatccctaggatggggcagcagctctacactggacctgtggggttatttatactctttcctttcttcctttttcccaccaggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaattcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaattgctgctgtggtctgattctaaatattgtatgaggttccaatggtcattttaatcccagtcatcttaagtagtagtacagagattgaatgttcaagatttcacatcattttaggcttgtggatctccagtagacttctccctctttaagagcaattctaactttaaaagggcagaaccagagaaagaattaagtgacagaaattgacatttctgaataagaggtgtattcatctgttttcacattgctataaagacactacctgagactaggtaatttataaacaagagaggtttaattgactcacagttccacatggctagggagacctcaggaaacttacaataatggtggaaggcaaaggagaagcaag

SEQ ID NO: 15121 - DNA, 1188 bp, Homo sapiens
tttttcaggctttttgttaatttcttaatgcttctatctttctttaaatgtgctgtttgtttgcgtgctagagtgcccagttgaacaagctgagcaggcttccccctgcgtctccctgtgcctcagaagaagggtcatgctttttgtcccttcctccttctctcttctccccttcccccgcctggcctgctgttacttcagtcttttccaagatagaatgaatagattatttctttccttccaatatatattgttttagctgcaatttagaaacactccacccacatactcaaatcatggctgtagagtttatgcctgtgtgtgtacacattatagttcattgactctgtgcaactattcttcagggacctagtacttaagatactgtactcatatttttccctctttacccaccgcccacagttttcccacccttacttggctctctcttagtcatgggctggcttgaccagtttaattactttttttctgtttcatacttctacaggaggagacctctgaacagatcacaaatgttacgtgagctttttcctgttttcactcacctgccatttccaaaagatgcctctttaaacaagtgctcctttcttcacccagaacctgttgtggggagtaaggtaggaaattttgagaggacttggatctagaattttctttatttgggacctggactgatgtcataaccaaggccttccctgcatattggcttagagggttacagggtgaattgaggggacacccacacagtctagttctcccctcctgctgctagccaggagacttgcaggggcccaccttgtcatgaaggcaggtttccagaaaatctagttaccttgcaaatctgcctcctgcccttaacacctgaggcaaactacttttctatattaaaagaagtgaaatcttaaaatttgaaggacttgagggtgcaattagtctggctttcctaccttaaattagaaagtaggcaagcagccatgatcggtggtcgctcacgcctgtaatccagcacttggggaggctgaggcaagaggattgcttgagcctaggagtttcagaccagcctgggcaatatagggagaccctatctctattttttcaaaaaaagaaaagaaagctataaggtaatagtatgtggatgaatagaataactgctccattttgtggata

SEQ ID NO: 15122 - DNA, 1157 bp, Homo sapiens
cgcttgcccacctgcgcgccgcgccctgcaacgacctgcacgccaccaagctggcgcccggtgagagcaccccccgcctccggcccggggatgcggggcggcggcgggatctcctgggtggggagctggcggctcgcgggccggcactgagtccccgtgcttccccctttcctaggcaaggagaaggagcccctggagtcgcagtaccaggtgggcccgctactgggcagcggcggcttcggctcggtctactcaggcatccgcgtctccgacaacttgccggtgagtgggcgccccgcggtggggagggcgcgccgggcggggggcgcacgggcgtgctttagcccggacgagggaacctgacggagaccctgggcttccaggtggccatcaaacacgtggagaaggaccggatttccgactggggagagctggtgagtgccctgcaggagcgacccccaggatgagtgggtggggtgaggggcgcccccgactcccgccctaacgcggccccctcgcccctgcagcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatggtgagccaggcccgggagggagctgcccaggtgactcggcccggcccggcccagtccggaggcctcggccagtctcccgcgccagccttttgtaaaggtcattgggccgcctggctcgatgctagccggggtgggacgcaggagagcctcccagcgtagtaaagccggggattttcagccagctgaacctgtaatgtttctggcatgattttattcttcaagtggaattcagttagttccaggctttcccgatgaataagagg

SEQ ID NO: 15123 - DNA, 1746 bp, Homo sapiens
tggctgttttgccagggagtaaaaagttaaaagctcttttagcatcttctttaaggcagcagctccaaatattttggtaccagtgacctcactgtgggtggtgttcgtgtttgtaagttggtaggtgaattgaatcatttcatcatgctcagtggtgtctcatcaaaatctcttgtcatcatccttcctatttctggtgagtgggtgttgtgggaaaggcccccactattgaagtttgaaaaccacaggtttaagaggggagtcagtttttagctgaaagcagactggaggacccagatattagtcaataccttcctattgaagggtacccagcacagtgttctagaaaatgcttggcctccctgggaccccagacttgtgggcctctgagaagcaaatggggaagacctttgcagtgtaaaaacaagttgagtcattcataacctcgtctatcctcctttctgcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctct

SEQ ID NO: 15124 - DNA, 1544 bp, Homo sapiens
tgcccatcagcatttagtcacatgtctgaatttctgtgtccagacgagccccatcaaactagttgggaagggccccagtgaccaagtgtataagcatcccttgaagagggattggggcaggggaggcagaaggggctctccagaccccttttccatgatgacccactccaagatattatgtgtaaattgtgttattatgtatatgggtaaagatgtacaaatatatgtcctctttgtagcagatatgattttatatttataatgtgcatcaacatgtgaaagcaatctaggtcactagcacagaggaagttgccaggaaggtggcttcagcacctccaggttggttctgggtgtcctgctgtgaggggtagaacgggaggctgctgaagtgagtagctgagcagctggagccatcccaagcatcagtgtctcagagtcctcctcgcccctttcttcaccccgccccccaacccccagactttcctggagcatctgccctttgctcctagcagcctccccaggaagggactgcagaggcgggcaagccctctctatgtgtttttatccccaccttccccggaatctggggagggcttttgtttttacgttttcaagttcagcattgtattcggacagaagctgtgactgaagactcagtgccaaggaaaggggcttcttgtgtgtccctcgggtttggggctcttctcagagagcagcactccatatcccttactgtcaccttcactccccacacagctcatgagatgtgtgacccctgtttgagttttggtatttggtagtggagggtggggggatgggggccagcagctgtcatcctcctgggaagccgagcagtgtccctggtgggtaacaccctcaagtctctttgccagtgaggccccaccacatcggtgtgagttaggtttctcatctggagctgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctccatctgctggtttttctcctgtatgtgtccatggaacctaaagagtctcctctttttgagtttttcttgctgatactagtaggtgtgtggtcaggccttctgtgaggtgagcagggcatcagcagaggatcaaccagcaaacacttacccgacatccatctatgaaaggtactgtggaaactacaaaaatgagtaacttggtaaatgaaactactaaaaagagttaacttgccaaccactttgagaagcactttacatggattatttcattcatctaaaagaagtatgttatctgatagagggtagaaaacagactagaatttcagtgctggatgaaaacttggagatatctagtttaaccccctcattcgcagaggaaaat

SEQ ID NO: 15125 - DNA, 1104 bp, Homo sapiens
ccgatggtgcccagggcaaagccagggccaatggatggaatttacaaggagaaaaatgccaagtcagagacattttaaaaattggagggcctgccttatgtaaagttactgacagtatttatgcgttgatgggatgtgtagaaagaattcctctatctcatagtcattgaaccagatgacctttcaagatcttggcaaccctgagatacatggataactctttttcagctttctcttgttgtcacaaccgtttgcctttttctacttggtggttctcaagacagctgaagaggagatagctgatgcactgttttggttccacaggtgtctggtttcttaagtcaggacctgcatatgctgctggttgatgagatttgtaaaggacctcccttttcagcacaatgactgatggtatttcttgcattgttgttgtctcccaggtgactgtaggacgaggatttggtgtcacataccaactggtatcaaaaatctgccccctgatgatttctcgaaaccactgtgttttgaagcagaatcctgagggccaatggacaattatggacaacaaggtacaggaattcacagaagcctaatgacttttatttgtttttaaattacttttttttttttttgcataggtaattcatggtataaaattcaaaagtataacttcttctttcctagccatccagttcccttttccagaggcagccacttccatatgctgccagagattcgattatgctaaaataatttctcttgatttgggttaaagtttgttaacttgaagagaatacctgaattggggtagtaggtcctattccagaaactagactaagttactgggcaaataagcctgtttgaggtgaagctcccagagaccctgggaatctgcagaatctgctgacgcttctggagtacacttatggctcagtggacaaggggaggagggagaaactgatctgattgcgcttagctcctttccttcctcactcctttcaatctgagcaacctcccctggcctttaaaacatgttttaaatattggtgttccgaagatttcctttgaataatgggtttttctcctttaaacaaatttgaaaac

SEQ ID NO: 15126 - DNA, 1300 bp, Homo sapiens
aaaaatcaagcaagaaggggagaaggggtgatggtgaaagccttggcaattcttgatagggtaatcaaggaaggcacctctgagcaggaactatttgagggaagctctgaaggaggtggccatgctgccatgtagggaaagagggaatggtaagggggagcatgctggtatgtgggaggggcagcaaggaggctagtgctggggagtggagtgagcgctggggagtgggtaggagaggaagcttgagcaagacgcagattttgtagggccttgtaggcctttgaaaggactttgactttaactcactgtgagaggaatgaggagtgggctttgagcagagagtgacatgatctgacttctgttttctcagttcgctatggctgctgtgtgaggaagagacagggtggcgaggctggaagcagggagtccacggaagggaaatacaggctcctcatttatttatttctcttctttttctccaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacaca

SEQ ID NO: 15127 - DNA, 2075 bp, Homo sapiens
gcaattctcatgcctcagcctcccgagtagctgggtttacaggtgtgcgccaccacacctggctaattttttgtatttttagtagagacagggttttaccacgttggccaggctggtctcaaacccctgacctcaggctatctgcctctctggcctcccaaagtgctgggattacaggcttgagccaccgcgcctggctccatgaagatgtttttatgaggagtctgagctaggcctggtgatgtgataggcattgtgggtattttgagggtgggtgaggcaacactaaagggtgttaatcaccagaagatacatttcctgggtgctgtagctctggtgggagctctggattgtacttgccgaaaggcttattttactctccctgcattctccttcctgttgcccattgagctgtcttgttttccttcctctcctgtcctccacttgcctttgcagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtagggacattgaggagggtactaggaggtatgagggacagcccctctatggggacttcaggtcagaagcagttgttatccacatgccatattttctttcctaggtctcttaccctgggcttcacagttcatgtcagaatcttggttccctctggactatccctttttaccctgggcctgcagaatacaggtcaaacactccctcagcagattctcatcaaggccctattaattcctcctttcaggaacactctgcttttgtggtggcaggagataatgaaactgcctgatctctggctgagaactggcagggtttttaacaaatataaacccaatgcccatctctcgccctctgtgccaggtgcagaatgcactgggttgcagacagctcagcaacccacagcagtccctctgttctatgttgattgtaatttgacagcaaatcctaagtcctttctgaacagtccttattacaaaattgatgcctaaatgtaggtgccttaaacacaacttgggtcttaaagagaaagttccacgagttgatgacttttgactggtcaactcctttgggactgtgtttcattatagcagagtactgttgttcctcctggtccatcactgtaagggagccttgcaggatgggccctagttcttgagacacctgatgcccgtcttcactgacccagagcactcgtgtcccagctcctgacatgtatagggcagatgaactcactatgactcttgtattctgacaggtgagggtgggattgatggagatggagatatcacccgcccagagaacatctctgcttttcggaattttgtcctggataacacagatcgcaagggtgtccattttctgatggctgatggggtaggttaccttttttccatagactgatgcattaaggatttgttattttagaggtttgagaattgtttgttttatctggttctttagctgctcccaaagatggtatttcacagttcagattgtagagaatgcatttttattctttttatacattttttaaatgataattgtgtagagactgatgttgtggatacctttgcctggagcagggtgatcttggtgttgctcctggtggaggctgtctatacatggtcacctgtaagcctctcataggctgacagatggccacctaaccaaagacggcagcacagaggaatccacaggaggctcttgtcagggctgggttaaagtgaatgttcaagaggccttgtctatgggcagctgcttgaggcacagagggaagcccattgcagctttgttcagcagaagctctcacccagtaatctgacaatgcaggcattcctttctggagtgagccaccacttactctagaggaaggacagacaatttggcagctgctccaggatcatatagctagagttgaga

SEQ ID NO: 15128 - DNA, 1922 bp, Homo sapiens
cagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaatgcctgtgtggctctgtgttggggctgctgctgtttgtcctcagtgctttgtgatctgagactggcttggatgaaacagcttgagccagaggtgaaggggaagcagctctactcaaagcagaggagagaaaagagggtttgtttaatcggagcctgttcaagctcttgggcacctgcagggctcccagggctgctgcttgctgctcaagagggggctcaaagaagagttgggggaaattgtgcagctcctgttacaagcagggactgcagaatgaatgaacccacagccccggaagggcagagaggcaccttccccccttacataaatcacacagctcactccatggtggcactgtgacaatccaggatcagtctgtgtgactaaaataacagaggcgtcagaccaattagtgtcactagacttgggcgaaagagggagggagagatagatggtttcactgaccctagcctgcctcccctccaaggagggctggttctgcctgcacgggactgtgcttgggggtgggggatgcagatgctgcaggcacctccctctctgttcccggctggtttctccaccagttagtcatcgccctggtgctggttgccccccaaagtccgccttcactttgctggacttcctcactttggccccaagagtcctttgtgtatggccttagttccctgggcaaccccatcccttgtttttcctacttaactggtttcatctcggccatccacgcccttcctctgttctgccttgctgtagcctcccacctgctcccctccttattccaaagctaggagttttagagttggggggtggaagggtaagggagatgtctgagtttgctgctcctgccacaactccccctctgatcagccccacccctacttctcactacaaaccctacctgatttactggccactgtcaccgtaagtctgtctggtcattaccatgactcttcctgcccactcacagcctccccagccttgcctgcctgtcgaagatggattaactccgcactcccctgggatcgccacatgaccacttcaagtccccaagccgcccttcgctgcacagactgcatttttttctgccataattacaagcaatggcactgactggagggcatgacagtgtgtggtggggggatggacaggtggcacaatg

SEQ ID NO: 15129 - DNA, 1383 bp, Homo sapiens
aagagatgttcaagggaaagctctggattacaattcagaatagaggagaaggcccccagctcgagtgggaaggagacagtgggaagcactttccaagccaaatagtgggagttacttccagggctcgggcactgctggggttgagcagcagacattgtgccacctgtccatccccccaccacacactgtcatgccctccagtcagtgccattgcttgtaattatggcagaaaaaaatgcagtctgtgcagcgaagggcggcttggggacttgaagtggtcatgtggcgatcccaggggagtgcggagttaatccatcttcgacaggcaggcaaggctggggaggctgtgagtgggcaggaagagtcatggtaatgaccagacagacttacggtgacagtggccagtaaatcaggtagggtttgtagtgagaagtaggggtggggctgatcagagggggagttgtggcaggagcagcaaactcagacatctcccttacccttccaccccccaactctaaaactcctagctttggaataaggaggggagcaggtgggaggctacagcaaggcagaacagaggaagggcgtggatggccgagatgaaaccagttaagtaggaaaaacaagggatggggttgcccagggaactaaggccatacacaaaggactcttggggccaaagtgaggaagtccagcaaagtgaaggcggactttggggggcaaccagcaccagggcgatgactaactggtggagaaaccagccgggaacagagagggaggtgcctgcagcatctgcatcccccacccccaagcacagtcccgtgcaggcagaaccagccctccttggaggggaggcaggctagggtcagtgaaaccatctatctctccctccctctttcgcccaagtctagtgacactaattggtctgacgcctctgttattttagtcacacagactgatcctggattgtcacagtgccaccatggagtgagctgtgtgatttatgtaaggggggaaggtgcctctctgcccttccggggctgtgggttcattcattctgcagtccctgcttgtaacaggagctgcacaatttcccccaactcttctttgagccccctcttgagcagcaagcagcagccctgggagccctgcaggtgcccaagagcttgaacaggctccgattaaacaaaccctcttttctctcctctgctttgagtagagctgcttccccttcacctctggctcaagctgtttcatccaagccagtctcagatcacaaagcactgaggacaaacagcagcagccccaacacagagccacacaggcattaaaaatatgtttatctttaatgatccaagattctgcaagacacactgatatacc

SEQ ID NO: 15130 - DNA, 1110 bp, Homo sapiens
gaagtattggtgaagaatgaaagagctaagtccttggggtatagaagtggaatagtgagtaagctgaggtgtggtattctcggcagcccccatttcaccttctgaatttgcttaaatgcaagactttgcttttgtgctggttttaaccaatgtgatgcagcatagcctaacacaacacagtggtttgtaaatcaggctccagtctagttctgtgacattaatgtgcaacagcagaacgtgtttcaacattatcagtgcagtttctctccacggtagtgatggtttcctgcagatgcacttagtctgacttcatcaaaatggaaatgttaacattggaattacatagatggctccaaatccagaaattctgtccactattgttatgtaaatgaacagtgtcaagaatggattttcacttaattttttttagagcctaaagtattaatagttagcctattctctgttggttgtggtagtattccatttttgttgctttactgaatgtcagtttgaataatatggattcatattatgtatagaaatggtaatgatttcacataaattgtcaaatatgtaaatatttgaatatacaagaatttgatgtagacattattggaacttactataaaagaccttacacttgtgatccttgcttcatatggacaagcattttctggagctgtttcctggttgtatctgtattttgaaagtctttccattaactttcatcttctagatccagaattaaattaagactaaatagaggctagttcctcaggcttacaatttaaactgctttcttcttgagaacacttatcacctaacctgggcccatgaaacttgagaaggcgaaatctgtatggaaataagttgtatttgttcaaaagattttcttgaatatctgctttgtttactgccttacattaagcactttagggagaagtaaatatatactacttgctctcaaaatccttaaagtctaattggggagggtaggcataagcattgaaatagcaacacagtatttcaagcaagaccactgaaatgtgttctgaaatcttcaagataccgcagtgtagcatctatctgtcttagctataaaatggggat

SEQ ID NO: 15131 - DNA, 1102 bp, Homo sapiens
attatttatttcatgattgcatcatccttcactgtaggtgattccatcatttttcttttttgggttatagtctttttgaaagcacagttggatataattgatgagtagtggtaaactatctggatgatgaaatgttaacatgtttcaagatataggaaaaataagatcgctaaacttccataatgtgtcttatatttataaagtgagtctattggaccaatatggtaattgcaagatagagcatgaaatttcttgcagtgactcaaaagtataaaggtcatgaaatgccaattcttacaattagttagaactgctgagaaagaaactaaaacaaaaattgagtcagatgaactaagtgttaagagctttaaaggtaaaactgtccaggtttcccgttgtacatatgagaagagggagtatattatcagtggcagagccatgggttggaatgggggctcagatgtgcagtcttagctttcacattccctcaggtggtactagaaagcaaactaaaaatttgaacaacagtcactcccttgtgagttcctctatagttgatggtaggatgtgaagatggtactttctgaaaacatttaaattgtatatgattacataatttgaacaaagcagtgtatcagtgctaaaagctagttggcagaaacttttgtcttaaaagtgatttatttaaaacttctactgaagcccagtggacttctacattccagcatccaggtgtccagtactctcatctataagagtgagctactcgtctagaggctaaggcaagtttcagctagatccagctaagctggtctgaactagtggaatgagccagttgtagctgttgtcattgcatctcccttttgagactatggaagcctaggacttagtctgttaattatcagagaggtcattgctgtatgtgttacgtgttcatggggctactgcagcagttatacttttttcagcagtctcaaaaagttgaatgtgaaaaatgtctgaaaaaattaaaaagggatgttttatttctaattgttcaatgatataagacttccagtactttagttttagtttctctcagtctttagtttattaaataaag

SEQ ID NO: 15132 - DNA, 1236 bp, Homo sapiens
atgcaatgaaagtaatctgtaagtggtaaaactctatacaaacatcagatgtcattaggtcgttctgactagattgtaagcaccttgaagtcctgggttgcccctgatgcttctttttcctctcataggtagtccctcgtacccctgcccttgcctggctggttaagtgaccctttccagccaagctagagttggcctcccctgttattccttcatagcacctgtcacaatttataattttaagttatttataacttaagtttttccattaggcattaagttccttaaaagtggagaccatgtctgctttgttcatatctacattcttagcacctataaaatgcctggcacatattaacagttttttattaatagttactaaaggaatggttccacaggaggacattagtaagtttagggccagggaatgccccttctctcctatatcttaccactggggaagcttttggtcttcaccttcagggtctatggggctagctttctaatgtctcctgagcattttgcatcttcccattaactgtgaatttcactgctggtgacttcattcaagtgaatctcagagcctctaggacacatcattgggcaagatgtggcagctacctttgctgatttgtttctattccatttgtccatggcattgtgggaaaagagatagatggccttggttccctagctggagtgaggtaggtaagagaacttctgactgaacatttccgtcctttgaattttggtacaaatgcaaaggctgccttgaggggcactcacagagccagcatgctttttcatatcttcctgtccatggtaagtgcccctttcataggagagctcattaagacccacattcaccatctaccagcaagaattccatcagaagttagttaccttaaactaagtgtgactttctgactcacatttatgaatatacccagttagattatagaactgcaacatcatacttattaccttgaaattacatttttgttctgaatgaccaagccttgtaaacaatgtaagtactacctaacacacatattctgaaacaagctccacgttaagcgttggtttgtaatgggtgatatttggatagctctgattaaatatgtaaattatgaaaattagaagtggaaaaaaagttacctttgtacttgaaccagctacatattgatctttgactcaataatggatcattctctctcttatagatcttggtcttac

SEQ ID NO: 15133 - DNA, 1232 bp, Homo sapiens
aacaattgcatcaaaaagacccaatgacttttataaaagtagaaggttatttttctctcacttaatagtccagggctgataggcaggctctttcttatgacctcatggtactcaggctggcaagggggctctgccatccttcaggggtgatttacatggttcctttggtggacttggtgatagcagagtacagtatgcccaatgtattaggaccaaggcttgaaagtgttatacatcactaccactcacgttcctttggtgagaacttagctattcgctacacctactggcaaaggaaaatggaaagtgtagtcttaagttcggtagccatgtgccagctaaaatttgctgtagaagaagggaggacaagttttgaaggtcttccacccaatcttttatctaatgttttctttgtacatagcataaaattccatgtcatattgtcaataccttggagccaaaatgaagcactttctctaactccccattctcacctctcgaaaataagtaaaaaattaaagagatatgcttgcccttgtgttaaaatggaagattaaccagatacattagttctgaaaaatctgcagaaattgatagaattgtttcctgccctgcaggagtctttgataatttgtgtatatttacatatccacaaaaatacgtccatcagaaggcctgctggccatttgtggaagataataaaaagaaattcaaactgagataaattctggtagagtatatctaagcacttcataggggagtggttgtttccaaggttaagagtatggctattgtagtctgatgcctttgttcatttggatcgtttaactctgttttttggagtagagacttgtcaagcacccccataattcctgtataattctctatacacaaaacagtgcaacaattctacagtctacaagtatttccaattttttaaaaaaattatttttaatttttgtgggtcatagtagatgtttatatttctgagttacataagatatttgatacaggcatacaatgtgtaataatcacctcagggtaaatgggatattcatcatctcaagtatttgttcttttttctgtgttacaaacaatccagtgatactcttttagccattttaaaatgtgtaatacattattgttgactgtagtcaccctattgtgctgtcaaatactagatcttattcattctatctaactagatttttgtacccattaagcatccccac

SEQ ID NO: 15134 - DNA, 1149 bp, Homo sapiens
ttacaggcatgagccactgcaccccgcctgtttagtagatattaaagttactagtagaatgaactcagcagagctgatttgtttgtcctagtacatgccttttctagttttattaacttttgaaaaataacattagtctcaagcactttgtggttgtgatactaatattacatttaaactctgaacattttttttgtttgtttttaatagggacagggtcttcccatgttgcccatgctggtctcaaactcctgggctcaagtgatccacctgcctcggcctcccaaagtgctgggattacaggcatgagccactgcacccggcctctgaatggtgtcttaatcctcatagatgttctgtattttctatccaataaacttgtctatgctgttcttaaatgcagatactagaataaactggaatgctagaattgtatttttttcaaaaaatacagaataaataagtaatcattaaccttgctttttctatttttaactgtagtaccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtaagtgattagcatgacttagaaactgacattatgtttgagatgacttagctttgtggtcatctacttttgttttacagatatgatggtttatttctttgtgatcattctgctatctcttgaaggttggttttggggaaggagttaaaggatatatttctttaaaagaaatacacttttttgtttgtttcttcttataaaaatatgtgtttattgtagaaaccatagaaaatatagaagagcacatagaagaaaataaaaattgctagtaatctcattacccattattaatcttcatatgtatctagcatttttttcaattatgcatggacacatacacacacaaaacagaaacctgcacaaacatagttttataaaatgaagattagatatacaaaaagctaattttacttttaaattaatacatt

SEQ ID NO: 15135 - DNA, 1104 bp, Homo sapiens
gttttaaaaaagatgaatgcagatgtgtttggaaagattaaatgtttgatgtagtggtacaagatacctgaacataaaagaatggtgctaccgtcttggttgtttacacagccataatgagtaggagaatatgtggcacaaagcataagggaaggagagggtcaaaaagagttaattggctaagttatacttgtcctgtaagcttttactgattggtcatgcagtggttgaacttcatataactggaattttacctttttatccttttcagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcagtaagtacctgtctatcctaaactcaaccaagaagcttggtatgcctctcatgccattaaaaccgcaaagctactacagaaccgtgtagtgcaggtgtacatgaaatatgtacgtttataaacagctagcctatggaatgtctttccctttcattttcctgttaattcctcctgagattgattagcttttgtagacccccaaataggtatttcttgccattcctggacagatttctcaactcctccccagaatgtcagaaatggacactttcctaaaaagctgctgctcatgttaagaccttttcttccttcctccatcaaataaatactgagtacattctatgtacttattattttgggtaccatgaacatggagattcttttttttttttttgagatggagtttcactcttgttgcccaggctagaatggaagttgcaatctcggctcactgcaacctcgcctcccaggttcaagcggttctcctgcctcagcctcctgagtagctgggattacagccacccgccaccacactcggctaatttttatttttagtagagacggggtt

SEQ ID NO: 15136 - DNA, 1143 bp, Homo sapiens
tatcttttcctatagagttttactttttaaattgccttattgacctttaacatctttatatcaacttcattgtgcctctcaaaagatcactctcatctttctatttaatatctgtcacatatcttgagctttcagagtatctcattagttcagtggcttacagaattaattcaaatagttttaaaatcattcctcttgtgtcctgtaaagaaccattttaaatgattactttgcattttttcacttggatctttgtgtcattaaaaaaatttatatttgcataatgttgataactgttatttccaatattttgtagcaaatcctatttgagggtttcttcatgtgtttcttccctgatgtgcagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaaggtgtgtcatttgtctacaagtaatttataggcatgcattgttttatttatacctatactgtagaagtatagcaatggactaagaataataaaaaaaatcattggtatcaaagcgttatcattggttatctggtctagccacttgcatctagctaccaggactctagatcataaaagagaggggctggttggttgtgttttcttttaaggttcttcaggtaagttttatgtgcaaaagagactgtgctgctgtgtggttgttttcaaggtagtgacaatcaaatagggtcctttttggtattgcatactaccttttggttttgtttttctctgacagagagtgtgactaataattccttagagcaagcaggcaaattcatagaggagatctgatgcaacatttgatgtctttaagt

SEQ ID NO: 15137 - DNA, 9402 bp, Homo sapiens
tttatatatgtgtttgtatgtgtgtatatatatgaaatagcaacaaggttctttatatttttcagtacaaataaacacagttctcttttggagatagccgtttctatttattaacaagtaccataatttcagctaaatgttactatatttacagaattgatgaattacagaagttttcatttttgtatttcaaatatttacagatgcatttttcatgatattttttcactgatttttcctcctgcttattccattaaaataggcttactacatatagctcttctttttagtaaaacttgaatattaagttatgttgattatagtatgaattagcctttcctgttgttaatgattcaggcttgttgttttttcattgcaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacagtgagtatgagtttctatatttatatatattatagattttttaaggtagtttttaaaaatcttttttgttttgtttactgaccagtataattcaaaccagatctgcctatgacttcacatttttaataatatattgaagtgtttttcatgcatcttttgatctttgtattgttcttgggcaaatgagatgtgttttttttagagacaggctctctgaagcctctaacttctaggtagtcttcctgcctcagcctcctgagcaccttggactacacatgtgtgccaccacacccagctagtttttgtttgtttgtttttggtagaggcatagaggcaaggtctcactatgttgcccaggctggtctcaaactcctggcctcaagtgatccgcccgcctcggcctcccagactgctgggattataagcatgagccaccacgcctggcccatttgtcttttatttttatttatttatttatttattttttgagacagagtcttgctctgttgcccaggctggagtgcagtggcgcgatctcggctcactgcaagctctgcctcccggattcactccattctcctgcctcagcctcccaagtagctgggactacaggcgcccgccactacgcccagctaattttttgtattttttgtagagacggggtttcaccatgttagccaggatggtctcgatctcctgacctcgtgatctgtctgcctcggccgcccaaagtgctgggattacaggcgtgacccaccacgcccggcctccatttgtcttttagataagagaatataagaccctgaaattgtaagatatttgcctgtttgtctctaactaatttttaggtactataattagtctttcagcatccaaaattttgttcttttattattttgctacattttggatccagaaatgtgatatcatgtgttcctttaaaaattcttcaaaccattttgtaataattaacattcaaatttggtatttttataacttgagcacttaaaaatgtaggcaatttctttacattgtttatctgcatactttaaaagagattgatttcagagtgtgtgatttcgtgtgtcccttgattcaaaataaagctttggaatcaggcaggcttagatatgagtctgtgactctaaacaagtaagtggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtaagtttgcctgtttttatgtgatatatgtagatttgtgtgattttgtattatgtatataattatgattttaataaacctaaaacattaatgtcctaattaagtatgatcaatttattagagatatgattatttttattttccacaaataatcttatttaggagttgtttaatttcagagtctcgatctaaaattacacttaccatctcaccatgatttacttttaagtctcagaattaatttccagtagacttttttttttaaaaaagctgtagttaatactaatcccagtttctgctagcacatacacttctgccttgatctccagtctctcaatcaagatgacagtattgcaggcttcagctggctgctatagtcaatgccaaccacaaacctattaagtattagtaaatgattactgttttttggtgtcgattattcttaactgattagactgtatatgagctgatattgattaattttaaataatttataattcaaggcaactaattaactacttatacccagcccattagatctatatttgttctttaatgtattatagattttgaacctacctaagtctgttcccaagtgccttatgttttgaaataaacaagttttggaatctacttgtggtacttggacaccctgttataattatttcttccttctctctgcttttttcggggggtatcacgtaaggtcatattggaattgctgttcctgatgtatacagtgcttgtaaaaggtttgaagaactgggagtcaaatttgtgaagaaacctgatgatggtgagtctactacttactgtgttcaggcctgtctttagttgatatttactaaccacctacagaggccactgttgtagtaaaacccttttggctacaagtaacagaagtctccacttcaaccagagttttaaaaaagagaaatgattggaagaatatctgggtattttagggaactgaaagacagcaactagggtggctttccaaggcactagacacaggacctggacagccatcaaaaccctacgcttcctctcccactgcccgaccccaccactttctttcattggccaccagctttcactatttcagtgtatatctttccgcccaaaaataagttccttaaagtccattttatctgatgctcatataatgacaccagctctctttagtttataatcacatggtatttctttttcatcttttataacctttgtatgtccttaagttttaggtaggttttttgaaatagcctacgtatggattttgctgggtttacatgtattgttattattttacttagatctctttctgaactatttcaaattaaaattgaaatattaaatatttcagagtctcaatctaaacatttgaaatatttcactgtttaatttcaatccttttttaaaaaaattaaaatacttaatatccagtgctgggcgtggtggctcacacctgtcatcccaacactttgggaggccaaggcgggcggatcacgaggtcaggagatccagaccatctgggctaacatggtgaaaccctgtctctaccaaaaatagaaaaaattagccaggcatggtggtgggcgcctatagtccgcctactcaggaggctgaggcaggagaattgcttgaacctgggaggtggaggttgcagtgagccaagatcgcaccactgcactccagcctgggcgacagagtgagactccgtcacaaaaatatatatatatttaatatccaaatcttctccccaataagaaaggaatttgcttcactctgtcctcattgtgtcactattacctagagtgggatagtattgattttattttttaaagataataataaatatatcacggtgtttgatcactttttcttcatatatctcttgtagtgtctcctttgagacaggatctcactctcatccaggctggggtgctgcaatggcactgtcatagctcactatagccttgaaactcctgggctcaaacaatcctctgcctcagcctcctcctaagtagctaggaccacaggcacatgccaccacacccagctaattgttttatttttttgtagagatgagttcctgctatgttgcccaggtttgtctcaaactcctgagctcaagcgattctttcaccttggcctcccaaagcactgggattacaggcgtgagccactatgcccagcctttttagcatcttttggatttttctgttcttttatttaaatacctcaaccaaaatggtctttaaaggggttttgtttttgttttttgagacggagtttcgctcttgttgcccaggttggagtgcaatggcacggtcttggctcaccgcaacctctgcctcctgggttcaagtgattctcttgcctcagcctcccgagtagctgggattacaggcatgcaccaccgtgcctggctaattttgtatttttagtagagacggggtttctccatgttggtcaggctggtctcaaaatcccaacctcaggtgatccgcctgcctcagcctcccaaagtgctgggattacagctatgagccaccgcacccagccctttaaagggtttttaaggcaaaacttttgagattctgtgtaactgaggatgatgcctttatgtctgaaggacagttttatggaaaagcctaggtttaatttccttcagtcttgaaaatactcttctattttctttttgcatatgatgttgctgttgaaaaatctgtcaattcatgttcctttgtatattcttctgttttattctagaagctttttatattatttctttgtcactgcctgcattctgggagatttcctcaaactggaataccaattagctaattttctcccaaatgtatctgttctgatatttaattcatctattttgttcttaaacacctgttataattttgatctctaattttcgcttagtttgcttaatatgttcttgttctttttttcatattggtaatatttcatattgtttattacttttttttttttttgagacagagtcttgctctgttgcccaggctagagtgcagtggtgtgatcatagctcactgcaacctcaaactcctgggatcaaacaataatccacctcagcctcctgagtagctgggactacaggcaaatgccaccatgtatggctaattttttattttttgtagagacagggtcttactatgtatctcaggctggtctcaaactcctggcctcaagtgatccttctgcctcagcctcccaaagtattgggattacagatgtgaaccaccacacccggccggtcattacttttacatgtctaaatagtccttgggtctgggcatggtggctcatgcctgtaattgcagcactttgggaggccgaggcagaggattgggaggttcgggaggatcacttgaggccagcagttcaaggctgcagtgagctatgattgtgccattgcattccagcctgggtgacataggaagaccttgtttctacaaaaaggtttttttttaaattatctgggcatggtggcacatgcctgtagtctgtatgcctagctactcgggaggctgaggtgggaggattgcttgggcccaggagttggaggctgcagtgagctatgatccactgtacttcatttcagtataaacgacagagcaagaccctgtctccagaaaaaaaacaaaaatagctcttggtccattattctaatatttcttctgtttgaatctacagtccattgctttgggggtgttttatggttatgtttctcaaattattattttttgcctctgagcttttttcccctgcaactgttcgctattctaacacatcaagcagtgtgaataggagaatggccagatccctgtccttaacaacccacatgatctcaggacaatgggctggataagcctaggccagagattcctaggcacctagaaatgagacttaaatttatttcaccttccacaaaacacctcttcaggttggatcttcccacttcatccctcagggaagagtattagtaggagacacttccgatagtgttattccctagccctgggcgtggagagagggctggggagatcattcggccctaccagtttttctcagtttctcacaagcacaaggctcctgcactgcccttgtttactggtaaggacatctgaacaagcgagagggcaggtgccgatgcacacagcagtgagggaggagcaagagcaaaactctgttctctcgcagccattatgcactgccttctggtccaggccagaactaccacctcccacacagcccaagttaaaacagtcacccggccccatcctcacccattctccccagctgtcaccagccgggtttctttctttctttccttttcttttcttttcttttcttttccttttcttttccttccttccttccttcctctctctccctccctccttccttccttctctctttctctctttctctttctctttctctttctctctttctttctttttcctgcattttccatctatgttcctctaggattgatcttggagaaaggaggcagagataagagtcaaaccaattcaacataatggtccccaaataaatttctgaggtcatatttttccatttaagcaaacagctctgacatactagactctcaatctcagttttgaattcctgggagaaagactctcgcagagcttgggttgcctaggatagtatttaaaagggtttgtatgacccaagcatctgggtcttttggttgtgggggtaagccatgctaccagctcccttcagcacctccctattttctttttcttctttaaaataagacaatttctgtaactactgaactggtagtgtggtatcatgaaggtgaggcaaatgcctgatacctaaaagatgcagccagtcccacagtttatttcaggagggctggtatttgcaatgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaacctttgtccatcatgttctttctttaaaaaaaaaaaaaaacaactccccttagtgagtactgaaaggatttgaaaaggcttgtaggctcattctgaagagagaacaattgtgattctgtacagcccgtaaagcaggtagtgtctatggataagggagtgtgggaaaggtgggaagaagaaagtgaatacggaataaaggattgtggtagataaagtgcaaacagaagaatatcaaaaggtaaggaacttatgaagaccaatttcacatgttgagtgctagaactgacaaacgggagggctaatacattcacaaattcagtaatttaagctttatttccaaggaaagaagccttctccacttgctgagtaaaacttgccaaaagatagcccttgctcattctttaaattcattcctatatgcattttttttaaa

SEQ ID NO: 15138 - DNA, 1201 bp, Homo sapiens
aagatatttcataaacagagaaaaagtttctatcttaaaagatgttaatccaagtaattatgagacttagaggcaagaaatgaaatcattagaactcatttttgaggatctttggtggagtaagatatattttctttttaattttacgttatagcaggaggaatctctttctataatattaatgaaaattttcaccatattaaaatatatactttattatgaactcttaaaaatctatacttttattttttcatattgttaaaatgtacaattttatcagtaaattatgaagtcataatctaatgattaattagaattatatttctgtaaagtattagatctttaacatttcagtaattagagcttaaaagtacacattgacttttaacacattgacattaaatacttcttactattaaatattatttaatatttttattaatatatttaaaatatttaatatataaattagtattaaatgtcttttttttcctttttaggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtgaattgactcaaacaattgcatctggactagtagttttcatgtgcatcctagccattgtattttgtctctaacagcaaagggaagaggtgtctcctttgactttcttccagaatctagtttgaaactcagccaatttttgggtctagagcaaaatcattcttctttgtggaccatttgaaatcaattttaagatatttctcacttcaaggaagaaaccataacaatatgggttgagaatgaaagaatgaagaatcaggaatagccaacatttatccccaataatgtttaaattgttgatactctccataaaagagagagggagaggacacagtgaagagccagagtgctagacactaaataagtacctcttgttcgatcagtggagttgtctgtgctgtcaaagaagttcagactaggctgtttcacatcagcatcacagtggcaagcctgcagctctatggtcaaattttttctggcagtaaggaaagtagtgataggaatacaacatatgtcaaaattatgagaggctccaac

SEQ ID NO: 15139 - DNA, 1215 bp, Homo sapiens
ggcattgtggggaaaatatgttacttttattttctttcgtgagtctttcttattaagtattctcaaaaaaaaaatatagaaaaacccataagaaaaaaacaactgatgcttaagcaaatgagatattcatattaggaccagaacaggcagaaatatagtaatatctatatgttacttgaaagagttcaaaagactcttatgtatattctcatttgaatctcatagctaatctctgggataaacagggcagctgtgattatccccattttagccaaaagttcgaattgaaaacataatctgaaaaatgatgatttaagttccattgtttcatgtatgtggtacagaaaaataattagtagtcggcgattagtaaataattagtaaggctctagtgtcaagttgcaacacaatgatctgaagccttttcttggctgtaaaatgactaaatgaactgggtgacttacaggtccctttcaagcaaaaaaaaaattctatgatttgatgatgcacttaatttgtagttgaaaacatcatgacatatactttgcttttccttcaaaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacaggtaattttataatttgagagagagatttaaatgggatatttagggttataaaattctaagtaaaagctcagttttaaagctctttcattggatggattctgcactaaatttggtattatcttgtctgttcctatacaaactgcccgttttccctaataatcatggcctccatctcttctttaatggtactcatctccccttccctatttttcctggtgggccccatcctaattattcctccccagactggcatcttgtcctctgaaggtcttggctccccactgagatgacctcttcatttcatcttttctctcctttgttcctctgacatcattgacctcttggctaatcctgttcaaacattcacccaatggcccgggaaaagcctgctggccacccgtgagagcaatctaccactacagcaatctacccattaggggcttggcacttactt

SEQ ID NO: 15140 - DNA, 1146 bp, Homo sapiens
ggcaatcccctctaaatttggagaaggaaatattcacaaaagtgtcattgatgagctccggccaatataataactcatctaatttatctccagctatgcaatcacccatacaccatgtgggcagaaccaaagggccggaaggggaagctatcaggggctaattgcctgggacttaccttgttctctgacatttcattatattcactatctccattaaccccaaatcaggtttaatatgcaatcaacttgctatgattcccctaagtatgaaaatacaatgcaaaaggataaaccttgtcttgggtaattaaagaagggattcattagataataaatttgtttttttttaatgtgaatgttatttggttcacatttacaagtttgctttttttcgaagtacaagttgcatagtctcaaaggaaaataatgtccacattttaaattattttactttacagtacttttaattactaatgagggcattcctgttctcctttgaatggtgatatccatttcctgttgttcagattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtatgtagcatttggtgcaggggaaagtaatcttgaaatcatgaaactctttcaaaattttgattgaatctgcagtcataaagttgtcatctccatgacaaatgtttgctaattcacactcttgagttttgtaacagcaatttggggcaacagctctgattcttttctctcttttgtactctctttggatcctccctccccctctctttgtacatttccctgactccattgcttttgctaatgtcgaatgtggcttttgttccgggccttgggtttgggcctataggaaagtggcaaatagaacattgtgatccctcagttcaagaccattcatgccaaccttgctcaggctcttggtactacgtagcttactgagtccagctttggtgcttgcatctaataaggtgttaattttaaggtgagagtagacaagggcaggattccaacattcctgactccctta

SEQ ID NO: 15141 - DNA, 1148 bp, Homo sapiens
cctccctcctcccctgtgaggtgctggggcctggagagaagccctcagggagtttagaagggtctgctgtagacaccaggaaggctgggggttgccgtcccccttctcaagcatccaagctgaaactggactgtgcgctgtaaagacagagtctctcttctctctcccatctcctgtctccctgtgtttcaccctccctctcattctcttccgttaaataatactgtgatggattgtaaaaggtacttagctgaatcacagagtttagagatggaaaagaccaattaggtcatcaagctgatctctctcctgaggagctgcagaaaataggagacaacaataaacaattttattgggatattaatttaggagcccgaaggccttgacttgtgtctcttaatataatgcagtggatttcttcccttccccactaatgtaatagtggggccattttgttagccattggtttgcatgatggctttcgtttccctccttttcccatggaaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggtgggagagacactcccagggacaagggaaggaagggacacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttg

SEQ ID NO: 15142 - DNA, 1231 bp, Homo sapiens
gtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgc

SEQ ID NO: 15143 - DNA, 1144 bp, Homo sapiens
caaggacctggtctctgcaggtagaacaccctccatggagggctgggtgaggcacaggggacctccttgtgtgtgtctgcctcacatgtgctttttttgagaggcagaattaatctagtgcagtggttctcaaagtgtggtccctgtccacagcatcacctgggaacatgtttagaaatgttccttctagacctcctaaatcagaaactcggagtagtaggggccagcagtctgttgaacaagatttccaggtgatcctggtgcatgctagtaagttggagaagcattgactcagtgaaagaatgaactttggagccagattgcctgggttcatatctttaccttgggtaaatcaggtaacctctctgatcctctatacaatgtttcatctgtaacatggagacactgccaccttcttcttgtgatgactaaatgaaaatgcttacaaggagtttagtgcagttctgtcaatcagcatctgttaagtgtggcctcagctctgacctttactgtttctcattttaggtggtatctgatgctgcaggacagggtgtggccatcacagggaaccagaccttcaacaactggaactggcccaatgcaatgatttttgcagcgaccgtcattaccaccattggtaagtcttctgggacctgtaggacacccacatccatgccctagctcctcagaacctttctagaaacccagctctggtcactcagccctgttgggggtacaatcagatcagttgcaggctattcttttgatactttcttagggatttgttaagtccttggtagctgatcatgcctgggaaggtttccttgagtcttgacctgggctctttgagcagaaacaatgacacagcctcatggccagagccatgcaagagattaaccagactgctcattgcagaaacccagatcatgactacttaccaagctgggtgtctgtttcagttctcaggctgcatagccaaccagtccagaagtttggctcagaacgcagcttcttctctttcaccattctgtcagcttgactgggctcagctggctggttcttgcttgggctcccaatgcagtggcagtcgaacaatggctgggctggagtcttctgaaagccaaactcatctgatggcccagat

SEQ ID NO: 15144 - DNA, 1193 bp, Homo sapiens
tttaaaagcccagctcagtagtgttaagtatatttaccattatgaaacagatctccagagctttttcattttgcaaaactgaaattatacccccttcaacaacaattcttctccctctctacccagcccctgggaaccaccattctcctttctgtttctgtgaacttaactactttagatgtctcctaagtggagtcatatagtatttcttttgctttgtacagtggtacaaccactgtgaaaaatagtatggagtttcctcaattaaaaatagaactactgagtgatgcagtgctcctacttctgggtgtgtatcaaccaaacttctaaagaactagaaaagggatggggatggtggctgtctcttgcccatagcccttggggaggtgttctgcaggatggacccaacaggctgtagccacaggccagggaggtgagagtcacatgactaagctcttctgggttgccaaggaatttgaactccatcaaatttttgcaattttcaagtaggggagggaacaacatttcagaaagtttcctccacagccatttacagcttaaaagaagtggaacattctactctaaaataacgacatttctgtgggctgatcccttcactctgtgggtgttctgataaggacaccccctccttcctttctcctgctgatgtgatgtagtgtgggttttcccagaaagctcatattgcctacagcccccagaaaaacccactgaccttcacactctagttcttttcctactacgagccccttaggtccaggtctgggtccctggcccagccaaagacattccgtctcccgtttggtgaccttcccagattgcatcttcgctatccctttatgtagaagtgggggtggtgtgctccagttgtagctctgttcagctgcctaaggcctctaggcttctggtgagcagttatcccaatctctgaacctcagagacctggatacagtggagttggaaacacagaacgggccctccctactggctatcctttctgtgcttgatgaaacctcagatattggagagtctttaaccctctggagatcagtgcagctgaggaaagataattgggccgcagtggtgaaatgagaggaaatacagtccaaagtgctcagtggtgggttgtagatggaagaggctggagagatgggcaaatgttgaaggggctgggg

SEQ ID NO: 15145 - DNA, 1329 bp, Homo sapiens
gtctttcgggaatagatgtaccttagtacccctgccattttcagtcattagtggggagcagcccggaagagatgtgaccctggcacacatgctatgatggattccaaactgtagcaactgggacccttggctagttatgtgctctgcactagaaggtctgccaggtgcattttcatgccaccacacccactctgtgcatgagtaaacaaacacaaagaggttgaccagcatgctcaagaacacacagctggcacgtagtggaaacaggattccaacttgggtactttgactctgggacacaacttcttaacaactatgtcatgcttttttgttgttaaataagattttattgcattgaaaattcacattctttgtacagaaagaatattaagttaaacaattgtgcatattgtttgtattcttccagggtgaaagttataaattaattggattcatgggcctgtacaagagggaaaaacacacttaaaaaggccttaagtgcttttttcttctttccggctttcaagatgttgaagcgaggacgtggtgggtcctctggtgtgaaattccagatttccttgggtcttctggtaggagtgtgatcagttgtgctgacaacacaggagccaaaaacctgtatgtcatctccgtgaaaggggatcaagggatggctgaacagacttcccactgctggtgtgggtgacacggtgatggccacagtcaagaaaggcaaaccagagctcagaaaaaaggtacatccagcagtggttattcgacaacgaaagtcataccgcagaaaagatggcgtgtttctttattttgaagataatgcaggggtcacagtgaacaataaaggcgagatgaaaggttctgccattacaggaccagtagcaaaggagtgtgcagacttgtggccctggattgcgtccagtgctggcagcattgcatgattctccagtatatttgtaaaaaataaaaaaaaaaaaactttaagcccattaaaaagtcttaaggtggggcacttcaaaggcaggggcctatggatttgccagtgacctttaaaatgtgactgtgttgctgagagttcaatgattattgatgtatattccctttctcctcagtctacttaactacacattaatattgtttcttcccttgtaggctctctttatctttacctctgtgacacagacatctaactgcctatccagtatccaatattccttcataactacaattcccagtcccccaaaaagccaacaacaataatataccacctacctatccccacctctcttattcaggatggccatctgactaacttctaac

SEQ ID NO: 15146 - DNA, 1349 bp, Homo sapiens
tttcgttaacattctgttaccataagtgcatttttaaaataccaacctttcaccatccatccacagccaattttagtcagtagtcatagagggataatgagtctctaatgtcatgacagttacacatttctaaatgtagcatgaaatagttggaaagtagtatcttattaggcaaacagaagtgatagtttttggatgttagagctgtctaggaatggtcttcggtgactcacaacaagaattgacttccaaactcctaccatggttgcccataagggtgtcagactagattatttgtttttatgctttgagtggatatagcttaaaagagaggagcagtttcctagatactttcgttaccatcaatggagatattttgtctttttcaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgatt

SEQ ID NO: 15147 - DNA, 1137 bp, Homo sapiens
tcatcactttatcctttcaatcccacccctacccctgccaccaatagtgtttggtaatgatgtacagccaactttgaacataaattaagccgaaagaaactgagcttgtaggcattccaaaattgtgttcaaatctcacagtccaacagcttgttaatgtttttcatgcttgcttcatcttactcatatataaaacagtattttggattgtcattaaccccttgtggaataggaatgtaacatgctcttaactgtatggcttcttgtttgatgcatgtgtctttgtaacatttttctgttgtaaatacagtgagctctttggagtctcaaatcatttatcatgtgcacgaatagcacatcaattggggaggaaattaagatgatgaatagatagaaaattattaatagctgtatcttaaaacttgtgtttcctacttacatagattttatttaaaagaagtggaaacactttatggaaataatagaaacctttcctctagggatctgattattttgggagaattttaaatagttattttggttattcttgctatatgtattctgagaaatctttcttgatacagaatatgcaagcatttggtgtagcaaaggggatttgatttggaatggggaaataagggaaagagatagcatgagagagtcaggctgtaaagtccttaaaaaagtaaagtaaaggttctcaatggacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctg

SEQ ID NO: 15148 - DNA, 1335 bp, Homo sapiens
agcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctag

SEQ ID NO: 15149 - DNA, 1231 bp, Homo sapiens
gtgctctcaaaatataagctgcctgttctgagccacagccaaagcatggctcccagactcctgtgggtcagtggaggtggcagtgagggtttatgagctctttcccaaacttttaaaagctttgtggaaattctgcatgcagctgagatgaagcatcctgggctcgcagagatgccggggcccgaatgtgatctgctgctgatccaaagccctgagtaacaattacatgtgtctttgattaacgaagatgatgaaacagattattactaactggatagcatttagttagtagacagaactttccaagatgtggcagggagagaggaggcagctaataaaatgggtcatccatggtgaagaggctgggaacccctggctctatggaaagggtaggggcccgccttccctttggctgggtctcctcccagcccacccccctcccctgctcatccctgagctggggaaggtgggccgctgctgcgtgggacatgggatgggatgaggactatcatgtttgtgcttggccaagcaagccgcctctgagctcctcttcactgcacccacagaacgccgtgcgccacaacctcagcctgcacaagtgcttcgtccgcgtggagaacgtcaagggtgccgtgtggactgtggacgagcgggagtatcagaagcggagaccgccaaagatgacagggtatgtgggtccagagctggatgggctgtacctgcccagggggcaggagccaactcacccccaccccctacctctccagggtacacatgtgcaccagatccttcctggctgggggaaggggtgtggggagaaaggagcagaggagactagtgcttggggacagggggctggaatccggaagtgatggataatcagaaggcagacatttatgtcctcttctgtcctcactctgactgagggaaggggccaagaaggaggcctggtagcaaagagagacaggggccccaagtagccctggccagagctggcacacaggcagatgccagccaacgggccatgggtgaggggctgccacccccagggcacccgctctctcagctcatcaggatgactagacctctgaggtcccgcgaccccaccaattcatcttacggcagaggagagccagtgagggccaggggctggcaggaggccccagagcagatttgtggcagagctggttccaggaccaggtctctgccctcctggtcttttgtgctcagc

SEQ ID NO: 15150 - DNA, 1272 bp, Homo sapiens
tggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtacttgctggtcctgtctctttggagtgggtctagggctgacagcgaacgggaggattcaacccagcgggccccctccagagtgcggatgctgcctgaagggagtcggggtggggggtacagggaagagggaacacgcttgtcacacgcctcagccctgcccggggaagacgaggggtttgggtgctgaggggggcacggtccctcctcacggccacgaggtggcgctgcggccacgccggttccacacctccagcggcggccggagcgagactagttgatgtggcgagagggttgctcacaaaccaagtgcgccgcccttagctgcttatttggggcaccctgggcccggggtggggggcatgcttcttctgtcccacccctgttctgggggtgacctccc

SEQ ID NO: 15151 - DNA, 1172 bp, Homo sapiens
caccactgtctccattatagcctcacccgaaacgcataaagcacatcttgctgtcactggaccgtccctttgcttcattctaggtctgccagtaaggtccagggaagctcctcaaaaaaagggactgcgcttctatttctcctgtcccccatgggccagtccaaggagcgctgaataccaaacaggtacctgatctgaattcaatgactgaataagcagaaattgtaggaccctctccagaatacggtcatggccagagatgcctgcaccagcagcaaggaaggtatatggggatgacccaatagacagaggaagaaagcaaaaaaactccagactgccaattctacggaaacccaaagtcttcctgtctgctccccaaccatcagtcaatacaaggcccagaactcaacaacctcagtttgagtcacctagcccagcccaggacttaccgatcctcaagaatggttctgatcatggacaactgtcctggaaggttggctcacccagccttctcccaaccagccagcttaactagtccctcagatttgtgcttcctgggcgtgtgtgtgtgtgtgtgtgtgtgtgtgtgtgtgtacactggggtctcctcaccattgggtggctggggggctcgagggaggtcaagctcagcggggtggctattgcgggtgatgatgacaggctcttccatcacattgatgctgttgcactgcatcagatcctgaaggaggttgaagatttcctcagcccgggaacacttaaatgcaaatattcctggagaaggagaggaagaaatgaccctaggcaatagggaaggaccagaggagctcaacagatgcacaatgtgcaggaaatgtccctcaactccagtcccaggcctgtaggggcaggagagcctctcctcatcttgagcattctttttcttttcttttttgagatggagttttgctcttgttgcccaggctggagtgcaatggtgcgatctcagctcactgcaacctctgcctcccaggttcaagcaattctcctgcctcagcctcccaagtagctgggattacaggcgcccgccattacacctggctaattttttgtatttttagttgagacggggtttcaccatgttggtcaggctggtctcaaactcctgacctcaggtaatcggcctgctgcgg

SEQ ID NO: 15152 - DNA, 1372 bp, Homo sapiens
tcacttcccttgtcatgttccatacattgacttgggcctttttaaatcaggctggggggctaccccttcttaaatgaatactatatccctatctgaggttacctcttgtgagtggaagggttgctttcccaggtggttgggagagcacaaatgttgagaaaaggccttttagtctttatcaaaacaatgactaatgctgggcaacatatagcagaagtcaaacaaaaatgattcctcctgaaatggtaccttcattggttctgatgttcttttgcaaaaaatgtccggaagcagtatagaaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataaatgaatccttactcaaccataattatggctttaaaacccaaccaacagt

SEQ ID NO: 15153 - DNA, 2740 bp, Homo sapiens
tcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttacagacacctcaggtacccagaggcggcagcactggacacttaggacgttagtatttaaggagatttttattaaagaagagttccctgctgcataagccaatggctattgtgagggaaatgtccctttgcctttaatttatttacgtactgggtatagatgaatgtctcagttgcatctgaaattgaatcattctaaagagaagaaaataagaaccaggtaaaaactgactagatgctgccaaatcaaacccaaggtctcctaaccgaaccttaatgggcctgcttctctcccagggcaagtagttaagagtctcattccaggaaccctttgtagttagttggctggcatgtttacttgctgctgtagccagccaagatgagtgcacctaggccctcaaaaaggatttttttttacctcaatctagcctgaccctcatatctgtggttgcctctgagacgaacatccatgctagtataaaaatagttaggaatgcccttggcagaactgaagctcttattaaatggtggacagagctcttgccagctttgatccagcccctcagtctcggagttatggggcagggttggggggcagtgctacactgtaaagaatttccaggctgggcgcggtggctcatgcctgtaatcccagcactttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtcttaaaaaaaaaacaaaaacaaaaacaaaaaaaaaaaaagaatttccagatgtctcttaaaatgtcatgaataaaattggaaactgtagaagtgttaatgtgtcctatggactcaatagcagagtttatttttgtttttaatggcaaggcttctagagtcaatgattgtatgagtttgctactctggctgtgcttacagcttcatccaagtacaagggaagaaccaatgaggtggattggctgacagtggggcatgccccagcataagccctagagaggtcgacagtagtgcagaatgaaaacttggtcggggatggcgggtggtgggtgggaggagggtgggctggccgggagggagaaatggagtttgttctacttactgataaagctttgtgaactaattttatacaattcataaaatttggtgccttgtactcaattacggtttgcatggaattgaaaagattaagggaaaggatttcttcttgtcatttcaagtggcaaatgggtctgtgtagtgtttaaaggacatctggtatcacagacttttaaaaagcatttcatgtctcttgtgtgtgaatgca

SEQ ID NO: 15154 - DNA, 1215 bp, Homo sapiens
tctatgctagagatagagatttgggtggatccctgtagagatggtgactgaggtcaagggagtataatatgattgtgtaggtgagaaggtccctggggaataccatagtgtaagggccagcagaggggaagaaaaaaaggggaaagcatagagggagaagtaggatccttcttccaatgttttccctgcttactctaccccacctccctttcccactagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaagatggtcgtgtctcagcagtggatgaaaggactacaagagaaaactccttggggaaagcagagataagagtcaagaaaggccagagaggctgggcttgg

SEQ ID NO: 15155 - DNA, 1535 bp, Homo sapiens
tctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttggattggtgtgtgggtaagtctatttctgcactgtatgaggtaaggaggtggaagtcaatggtctaaagcagggatcattgagccttttctgtaaagggctggatatttaggctttgtggggtacatggtctctgacccaaatatagtcagttctgctttataatgtgacctatgcgttcctaaaaatcactatgccatgcaaaattgcacaataaagaccacaggtctcatgggaaaaatggggcttgaagcacaacactcaaatgagtgacacatttaaaaaaaaaggatagcttggtttttacatatgtcaaatggttgagaaattatatcacaataaatatggccttttatcttgaagacatgcactttgcttttggaagtggacgtcggaagggttgctcaacacaggtggggagatgagt

SEQ ID NO: 15156 - DNA, 1159 bp, Homo sapiens
cagggagctcttgcccagagaagctagatgcagtgagctcagaagagccaggagagcttggtaagctgggttggtgccacccagcagactgcaggagagggctggagctgggtggccagagggcagagctgcaggggaggaatgtgctgggtgttaggaccttgacggggtgcatggactgggcaggggattacagatggggtgagcagaggtacgcatgggaaacaagattgaagaaggagatgtgcaccatttatgaaggatcccaagggatggctgtggagcttggaatgttcctgtattgaggagcctccaaagccaaagcatggagccgggattagtaaatgcaatgctgtaagaagatccgtctcgatttgtgaactgtaaatgggcagtgctgggaggtaacttaggagacatttatcatgtcaagagttaggaatgaaatgttgaggacttggactagggtggtggtagtgtatgtagaaaagacgagagggaagtggaaggtttcaaatcttagctctgccacttgctacctgtgtgcccttgagcaaattacttcatctctttcaacctgttttgtcatctatagatagaggctaaaaacacttcacaggactcttgtttgaggattttaacttgtaacacacccagcacttagtaggtgctcaaggaataatgaatcttctcatgcgggaagaggcatggttttgtgactgggagggattaggggagtggagtatgaggttctgagtctgggagcccgggagaatgatgaagccttcacagaaagagatggaactgcttggggcctttgaattcagctttaggaacttctcctcctaaaccctggctactgagggctgtcacagaaaaccccacatccatgcagattgtgcctctacgaaaccacggcctctggctagagcagggccctctgggatactggccagcagctggctgtctccagtcagggtgtggactagggtgagagagtaagccacctagggcagaaacgtcaggaggtgctgggtttcagggccacgcccgcacttgatacccacagtgggacgtgcaccccagcctcctctcctgtctgcccttcaccactcaggagacaacctggcttctgtgttcactgaaaatattactccac

SEQ ID NO: 15157 - DNA, 2113 bp, Homo sapiens
tgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaa

SEQ ID NO: 15158 - DNA, 1242 bp, Homo sapiens
ctgactgagccggtaattccccttccgggccccaaggcccacctcttactgtcagcatcacttgccagtctgtacctactgggggtgccataagggggaactcaggagggctgtgacctgaccggtaacatggtttcctctctgaaggggaagcaaaacctatatacacctaggaaacagatccaaggcaaagaaacgggtagctggctgagatcacccaaactgtgcccaccagggtgggggagagagcaggtaggaaaacttcctggtgacctaggcaggtgcaaagaattttcatccccatgccctccttgtctcccaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtgagactccaacctagcatatcctagcccctgccagaaactgaggtcttgagtgaaatgagcagcacccaccgagtctgcctctccccaccaggtggcagagcgtgctctctattactggaacaatgagtacatcatgagcctgataagtgacaatgctgcccgagtcctccccatcatgttccctgcactctacaggaactccaagagccactggaacaagtaaggcgctggggtggggctgggtggtggggatccagtttgggaaactttgagggtatggaagaactaaagagccaggggtctcacctagtcacccagcaagtggggctgatgtcccctgcatgttgataggaccttgaggggctgactggagcgaaaagatgcctgtgtgcaagatctctgtgataccaaacagcagggcagcggcctgttacaccgctccttgggttcagctattctacaggtcctatcacagctttggagatgtaattctatgcagtgagaagctgatgtgaccttctttgagagtatgtgtaaagaatcccagggttttaggccgggcacggtgtctcacgcctgtaatcctagcactttgggaggctggcaaggcgggtggatcacgaggtcaggagtttgagaccagcctgcccaacatagtgaaacccccatctctactaaaaatacaaaaattagctgggtgtagtggtggatgcctgtagtcccagctacttgggaggctgaggcag

SEQ ID NO: 15159 - DNA, 1476 bp, Homo sapiens
catcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttccaggcaggggatgcctgccgggcttggagggctttctgtaccacatcttcccactgggcatccgatatctcccgagcccaggcaggaacccctggcgcaggcaggcttactccagccattgtccttttcaccagctctacatgttctgaaatcagagccagaggccattcaggcatagaaataatgggaccagctcccctccccaatccccgaatcaac

SEQ ID NO: 15160 - DNA, 1524 bp, Homo sapiens
tacattaagggaatagaagaagtttgaaaatgcttggtggtgatggaggactggggagacccagggataagaggagcccctgagcgcctgggggcttgttctccttgaatttgagttgtttatatggcagagaaactaaaattttttttctccacctttggctggaattgcttatctcctctcctgtgcatattttactttaccttgacatatctgaagggaagaatagagaatataagggaggatggaagacttccattcttaagcccatcgacctcctaacagtctccacaagcccagacccaagatattttggagagcgggagtaatgaagtgagagtagcttcctgctggggctatttcaggatgggtcccatggctatttaaagcttagggtgtggagttgggggaggttgggtgggtgggactagcaagccagctgaaagccatgtctctttcctgcaaggggcctcccttatttgagctgttttagtgcctgaggttttgcctggccctttcctctgccagggcttcttaaacagggagcagatgatgatacacccaaactcaggagatgcttgccagcaaaagcattgtcagttgcaaggatttgcctgaaaaaacctcagatgtacccaggtgtacgtgccactaggttgacaggttgtgtttaagagaccatgaccagctgggcatggtggctcacgcctgtaatcccagcacttcaggagaccgaggacggtggatcacctgaggtcaggagtttgagaccagcctggccaacatagtgagaccccatctctactaaaaatacaaaaattagctgggcatggtggcaggcgcctgtaatcccagctacttgggaggctgaggcaggagaatcgcttgaacccgggagggaggcagagtttgcagtgagctgagattgcaccattgcgctccagcctgggggcaagagcgagacttcatctaaaaaaaaaaaaaaaaaaaaagaccatgacttctcatgctggatctttctcttgtcctgcccaagggcattttttgcctcccttcccctttttttttgttttgagacagagtctcgctctgtcgccagactggagtgcagtggtgtgatctcggctcactccaacctccgccacccgagtgcaagcaattctcctgcctcagcctcctgagtagctgggactacaggtgcgcgccaccgtgcccagctaatttttgtatttttagtagagacgggtttcaccatgttggccaggatggtctccgtctcttgatctcgtgatccacctgcctcggcctctcagggtgctgggattacaggtgtgagccactgtgcccagccccttcccctttgcattgcacactcccacctctatccgcctttcaggaacccaagttgtggaagagcttgttctctcttttctactggaaatggcttgttctctaccacagtagcagggatggggaagtggcaggaggagaaaacccctccctctatcaccatcccccaagcct

SEQ ID NO: 15161 - DNA, 1408 bp, Homo sapiens
attcctggtggggtgaggcattcctggtgagggtaaggtggaggggctgcctggttggctctaagcaaagcaggaaaggcaggttgggatgttgactgacatgtatacacagatctcaggtgcctggacactgcaatatacatacatacataaacataaaccggaaatccatatgagcttggaggtagaggagtgggtggtgttggatttggtggtgggtgggttctgattgttcaacctagtaggtctcttaagtaagaggtggctgtgggtggttgacctttaggaagttggagagactggtgtgtttttagcttggttcaaacatcccttagcttgggctgagggccccctcttctttctgtctcttattgttggccttccaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtgttgtgtgtttttgtggaatatggtggagaaggctggagtttgcagtgggggcagggtgccgaggacaagcaccctgaggttctggcttctcagccaagggtattaggaaaccaaatgccaccaaggcctggtccaagcttctcgggcgtggaacccagcaccctgcgactcgggcagaaggttgcgacaatgtctccagagcgggttatcctttgggcccggctccctggccctcgaccgcgcagttttctgcccattcgtcaccacgttgagaccgggaacgccggaagaggcggggcaggggctgccgtgagcggaagcggcgccattcgtcttccgagcgctactgccagctgatgccgggagctaactaccgcgccggggccgggg

SEQ ID NO: 15162 - DNA, 1408 bp, Homo sapiens; identical to SEQ ID NO: 15161

SEQ ID NO: 15163 - DNA, 1128 bp, Homo sapiens
ttttttctaactcccacctgtcttgagccccacagaaagtagtgtcctttatccctgtgcttgtgccaccaggccctgaacaatgagggtggcatgaggacagctttgtcaggaccctacacatcccagggctggggaagggagggaaacagtgaggggactggagcctagagccaacttggctctgcatgtgtggaggtgacagctttctctgccccctgccaggtgaatgtgatgccctctgccagccgggtgatcctcctggagaacctgacccgcttctggcccatcatccagatccgcataaagcgctgccagcaggtggggccagggatgtggggtgtggccctgggtagggggctctgagccccataaacaggcagatcttaagccagaggaccagcctgggtctcgagcagctccaggggtgaggttcgagggcgtagctgaccccagcccatcccaaggtgtggagcgagtgaagatagtcctgtgtgtgtttcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctaggtgtgtgagagtgtgcgtgtatgcttgtgtctgtgggaaaggtaaggctattgcaaatagctggcaggcaggggtccatagaagctgtgagatggaggtttaatatgcgtggggagggggctggagttttctgagctgtgggaggggaagaaaggataaagagaaaagatttctccagtgggctgggaatgggatataccagttagcacagagcagttctgaagtaccagggggccttcggtttgggtgctggggttagctggcagtcttaggaagggtggacactgagataacatatgcttcaagcccctgacaccttcctcctccattctcacccccagactcaacggtgctctgcgccaggagcagaattttgctgaccgcttcctccctgatgacgaggctgcccaagctctgggcaagacctgctgggaggccctggtcagc

SEQ ID NO: 15164 - DNA, 1176 bp, Homo sapiens
gcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtct

SEQ ID NO: 15165 - DNA, 1226 bp, Homo sapiens
gtcattcctgtgtactacctgtagtattatttacttgatgttttatttaaattgactctttaaaaaaaaaaactaagttaccattgttctaggaaaaaatatgagaaatcatgggtttgtcatagttacgttttttcctagcatacgttaagacatgtttaccatgagccaccaaaaattctcatgcgagtcaccctttggaaaatgctgaatattagtcccacccttttattttgttgctgcagacactgaagcctaaggagggagggggtcacagcagaaccgggtctcgtgcccagcccaggtgggtgggtccccactgtgggagaggctaggcccctcccccaggtcaggagctgcctcggcctgggtgaaggtggctggctgactcagactgtacccacagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctggtatgctgttggcaggggacgtgggggtctcgggtagggagggcagtgtcctacaaaggtgggagtcagtggttggagcaccgtgaaaaccttgtctcgtgcagtctcagccgagacctcacctgcctgctgttacactttgcccaccttatgatgctcagcttctgccttccctgctcttggatgcctgctttccctttatcagcacccagtctttccatctgtatctcaggggcgttggtcctaagtttttctgggacttctcactgtcacactgcagggatgccttccaggtcatcttctctgactcttgttttctttggtttgttattttttcctccccaaaagcttgtccccacttgagaataaatatatcagaacccactttgcctccctccttcctagcaccacttgtgacatgagtgttaccccagccaccagccttctcctctccactcagggtgtcattcccagagctgcgccttcctcttcattccccagctggtccttgccctcaccccatggtcctcaaactgctgcttctcaaatccctagttctggggcaagagcgggcaggagtcctatca

SEQ ID NO: 15166 - DNA, 1513 bp, Homo sapiens
acctccactccctggctaatttttgtatttttagtagagatgggggggcttcaccatgttggtcaggctggtctcaaactcctgaccttgtgatccacccgcctcggcctcccaaagtgctgggattgcaggcgtgagccaccacacctggccgaaaatactgcaatacttctatattggttggtaaatagcctttgcccccagtgcccactccagccactctgacgcctgtccgccagcccacttcagctcctatgcatggaccccgtcctaccagccagagtgagtggggccaggggagtcatctttttccgttgcgggtacccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgtttctgagattcattccctgctcttgctcgtggaagatgttcctttttcccccgctga

SEQ ID NO: 15167 - DNA, 2655 bp, Homo sapiens
ccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagactgtggggtctttggttctgtttttctacttagggagggatgggggtatgaacgcgaggcaaactcctaaaattgctgctctgagtagcgatccgggctgcttgatgagaacggtaatgctaaggtgtgctttgggctgtttaattctatacgatttaatttaaggaaagttttgcggggccgaggaccttctccctgtgcgtggcttcgctaggtgttaaggccaacgcagaggagcaaattttaattaacaggaaaagtgacacaactaatccaaagcattgctgaagggtttgggaaactcatgggcacctgacctactgaaaagtcaaaaagggcagccttaaggt

SEQ ID NO: 15168 - DNA, 1181 bp, Homo sapiens
ggtctcagtcccttccctgcttccaccccgtccccaccacactgccccagcccgcttcagtctcccacatgccgtccctcccagcttctccaggcccaccccctgccctgcatctggcctcctgtgctcctggctaggtcctatcaccctcctgcttctctgttgcttttttgttttgtttttttttttgagatggagtctcgctctgttgcccaggctggagtgcagtggcacgatctcggctcactgcaacctctgcctcctgggttcaagcaattctcctgtctcagcctcccaagtagctgggattacaggcgcctgccaccacgcccagctaatttttgtatttttagtagagacagggtttcaccatgttggccaggctggtctcaaactcctgacctcgtgatccacctgccttggcctcccaaagtgctggaattacaggcgtgagccaccgcgcccagcctctgttgcttcctttaaatgccagcagtccacagcctggggagtctcccacaaacgtcccggtgtccaagctctcccagcagctggtacttctctcccccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcaggtgggcctgtacccccaccccaggccaaagctctggaaccctgaaggccccagtctccctcacaattcctttctttttgcccacccatctttctcagctcccataacctctcttcatgatgaccacaattcttcaccatgtcccttcttccccatctctcattctctcattcctctcacactgtccatttctcattattctcccctcctcaccatcgctcctcatctcccctatctccctttccccgtctgtctcccacccatggaccccaccagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctc

SEQ ID NO: 15169 - DNA, 1214 bp, Homo sapiens
ccctgggaagtgccacccctggccaggcggcagtgtgcagcccgtgctgttgactggcccagctgtaggccaggcacacactgccccattgtactgtgctttccgacgcagcccttgtcatagcctctaatccttgggctgcttctctcccagcccctcagagcctgtgggaggtggtgggatggactctgctggcactggtgcgggatgggttgcagctgcagctgtgggtggctttgttcttacagcctagctttcagagtcctggtgcagcctggcagcagtgtttggggaacaggcgagatagaggagctgagccccttctccaacagccgtcctctctttctgttgaccaaccagagaggctttttgcctgaggtcagcaagctggcctccctggttggcagggggagtgcttggcttccatctggcatggtttccggatgggagaaagcccctgagggtctggtggtaagtctgcgatgcttcccatcaggagagtgcagtgtgcagtgtgtccccttgggcatcctgcagcttgccattcctctgctttctctctgcagctccggagttgggctgctcacaaaccaagctgtctgtttatatggagtgcctggagggcatctgccatgagtctgtcgctaactgcactaaccaggagagctggctggttggggagaagacactaaccctgtgagtctgacctcagccagctaacctgccctggggtgccaccagcagggcctctgtcctccatccttccccgcagcctggctgcctccctccttagcttatatcacgccatctcctctgctctcttgttcttactactgcgtccctctattttcccagtctccctttgctgtgggtggggatgtgcccccttcacggccacctgcccatcaccagcctgctgctgggctccactgaccaccccccaccgtcacccttccccgagtcagcagcgtgctcttcacttctcccttcatacagaattggttcgagtttctgttgaatctgtgcttttagcacagagtttgagaagatccctcaattaccatgctgctgctgcttctcatgcctcagagacagatgaactagagtgggaagggacttttctcctagatcagatcatttcctccctttatcaagaagggaaggttggatagtgtccctgttactctcaccctaggataagaagttaggatcag

SEQ ID NO: 15170 - DNA, 1158 bp, Homo sapiens
tgctaaggagcccttccccagctcctggctcctgtaccagctgccacccttacagccctttagccacatgaggcctctggagaggagggcagtgctgggctggatttccaagagatgaataatggagaagcctgattgtgcagtggggaaactggagctgggggcttggtggccagctgacatgggctgtaaccagagacaggctgggagccatatccctacccccaattctttatttctattctccgatagtgaagggaggctggactgtcccctaccatcccctcttcctcccctgaccctccaacccaggctgtgttcccagggccagcaggcctatgaaatatgctgccttagactcagactaagactccaggagtttccctgtcctgtttgcctgtcctcatgtcatcccttccttcctgagcccactctggagctccagggcatgcccttctatctctcatacccctctgcccttgatcccacaacaccctgccaggctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggtgtgggaatgaggggccagacacacacacacacacacacacacacacacacacacacacacacacacacactctctctgtctctctctctctctgtgtctctgtctctctcctttcataggaggttagctggaagatgccttagagatcatctaattcctattaaaaaactggataagttctgcaggtgtgggaatgcggggccacacacacacacacacacacacacacacacacacactctctctctctctctctctctctctctcctttcataggaggttagctggaagatgccttagagatcatctaattcttattagaaaactggataagttctgcaggtgtgggaatgcggggacacacacacacacacacacacacacacactctctctctctctctctctctctctctctctctcctttcataggaggttagctggaagatgccttagagatcatctaattcctattagaaaactgaagttcttg

SEQ ID NO: 15171 - DNA, 1099 bp, Homo sapiens
gagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcc

SEQ ID NO: 15172 - DNA, 1192 bp, Homo sapiens
ctagcgcgggtttcagcgacgggagccctcaagggacatggcaactacagcggcgccggcgggcggcgcccgaaatggagctggcccggaatggggagggttcgaagaaaacatccaggtaatggccccaaggcaccagctgccagcagccggagggccggcgatgtccagaagtgtcttggggattccccctctgggcctggaagtccgctccatttacaaaactctcttctttgggtcttcgtgcacactaaagtcagtgggattaacattgacctgaaagggccagactactactccagcctgaggatctcgggtttcagggcccgcccgaggcattaggaagaaggtattcttggaacaagttaggaggttggtcggggtaaggcatggagtggggttgggtgggattcactggcattcgctgaaaacatactatgtgtatagttttgtttggggcttaggaaagaaggaaatgggcactttttcagccttttagtctttgataggtaacataggagaaagacatgaatggaagactagtaggtttcccaggctagaaaagatagccaaagctagaaaccaggcgttctgagagcatatgagggggaatggagtggcatgatctgtagtgattccaagccgtatcctcagcagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcaggtaagcaagattgaatcctctgcaggtagaaaagtagacctaggtatgtcccgtgttctggaattggtgttggtgatgttcgccccaggttgtccagttagaaccatgtagaaatcaaacggaaaataggcaacaggatctagaaccaacagtaccacaatacctatgcccatcttccttacttcagatgtggcaggctgggaaaagacaagcctccagggccttcagcttgtacg

SEQ ID NO: 15173 - DNA, 1099 bp, Homo sapiens
tagaatatttaataagagacatttgggcaaagggaggtttttggatgagaggataatacttgagggaattatctaagggggaggtatgaagagatattacacagagagcagatttcacttaaatgttttttcctgtccctctagaatttccgtgtggatgtagtacacatggatgaaaactcactggagtttgacatggtgggaattgacgcagccattgccaatgcttttcgacgaattctgctagctgaggtattggcaggcatggtgacaaggctggagttgctttgggaactgcactgacacctcacttggagaattaagtgtctcaagctgtccttccctccttaattttcctggaattttgctgagcattttaccttctcattctttgtaaatttctcattaaacattctaggaagagagatagctccctacctctggaggttggggttacggggataggtagggggtctgttgggtttttgcagataagtggttatttttccttgggcaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaaattttgggagaagtggactatctgggttcaaatcctggttgactgtgatgttgggtaagttacttatctttgtacatcagtgtctttcatctgtgagaacacttgccttgtctcccaagtttgccataattaaatgggaaacacgtaaagcattcagcatagtgctggcactcagacgtttactagttcttaggagctccctccatttgtgcaggagatgaagaaggcacagagatagatactctacagtttcgtctccaggtcagatgcactcggaacccccatgctgctaaagattcctctgaccccaacgaactgtacgtgaaccacaaaggtgagtagtggtagggtgaggaagaggccccacctgtgggtagctgctagttttagggactgagatcttctgacatgtttttcctccagtgtataccaggca

SEQ ID NO: 15174 - DNA, 1543 bp, Homo sapiens
atatcctcatcgctcagctgcggcctggccaagaaattgacctgctcatgcactgtgtcaagggcattggtgagaaccctgtgtgccttcctgggaagggggatagttcggttgcagtggggcaagctgactagggaactcagctgagacattcccggcaggtagaaagccaagagggttgtgcttttgctgttagtagcttaggaggagtattcttcctaaccctagaagggtttcctataggcacgttccctcttcctctccaggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtatggtatttgggatgctgttcaagttaggacctaaattatattttctttcaaggtgacagaaataaaaaccctgggctcctaaaagtataacctggtttgctaccaagtggcaaattagaaaaaggaataaaaaaacatggtttgttctcattaggtaaaaaggtggccagagttgccaacccccggctggataccttcagcagagaaatcttccggaatgagaagctaaagaaggttgtgaggcttgcccgggttcgagatcattatatctgtgagtatgaagtggtgagatgagtgggcagtgctctttggtgctgcagcttccttccagtctagatgtgaagtttatgagtaagttttacaggcaagccctgcctagactaaagtgtctctttggtccccagtctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaactttttgagactacttttgagtttgttttttgagacagtctcactgtgttgcccaggctggagtgcagtggtgcaatctcagctcactgcagcttcctcctgggttcaagcaattctcaggaggctgaggcaagagtagctgatgctacaggcatgcaccaccacacctagctatatgtctaattttttgtatttttagtagagacagggtttcaccatgttggtcaggctggtgtcaaactcctgacctcaagtgatacgcctgccttggggcctcccaaagtgttgggattacaggtgtgagccaccgcgaaaaacagggggcctcacttcagaactggtttagcatttaccaattaagaacatcagatgtgcactccagcccggg

SEQ ID NO: 15175 - DNA, 1255 bp, Homo sapiens
accagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggaagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaata

SEQ ID NO: 15176 - DNA, 1667 bp, Homo sapiens
tgtgcccagccccgtcttctatttttaaaaataaaatatttaaaaatggataatttccagggaaaatgtaacttattctaactcaacaagatagaaaacctaaagagatataacttcatattaattatattggtagtagttaaattagaccaaaaaactccaggcctaaatgattttacatgggagttctcccagaccttcaaggaacagataatttatctcttagacaaactattcccaagaatagaaaaatgtagcttcttctccgagaaaacaccaaatggcggatgacgccggtgcagtgggggggcctggaggccctggtggccctgggatggggaaccgcggtggcttccgcagaggtttcgccagtggcatccggggccggggtcgcagccgtggaccgggccggggctgaggccgcggagctcgcggaggcaaggccaaagataaggagtggatgcccgtcaccaagctgggccgcttggtcaaggacatgaagatcaagtccctggaggagatctatctcttctccctgcccattaaggaatcagagatcattgactttttcctgggggcctctctcaaggatgaggttttgaagattatgccagtgcagaagcagacccgtgctggccagcgcaccaggttcaaggcgtttgttgctatcggggactacagtggccacgtcggtctgggtgttaagtgctccaaggaggtggccaccgccacccgtggggccatcatcctggccaagctctccattgtccccgtgcacagaggctactaggggaacaagatcggcaagccccacaccgtcccctgcaaggtgacaggccgccgtggctctgtgctggtgcgcctcatccctgcacccaggggcactggcattgtctccgcacctgtgcccaagaagctgctcatgatggctggtatcgatgactgctacacctcagcccagggctgcactgccaccctgggcaacttcgccaaggccacctttgatgccatttctaagacctacagctacctgacccccgacctctggaaggagactgtatttaccaagtctccctatcaggaattcactgaccacctcgtcaagacccacaccagagtctctgtgcagcagacccaggctccagctgtggctacaacatagggtttttatacaagaaaaataaagtgaattaagcgtgggaaaaaaaaaaagaaaaatgtagtgctccataactcattttatgaggcttatttattttgataccaaaaccagacattaacagtaccaaagaggaaaattataggcctaaatcacttgtaaacatagagacgaaaatcccaaatcaaaagcaatatggagctagtaataagtcttttaatataaccacatttccattgttatatctcaaaatactaccagtaattcaatatccagtatacaatcagtattcaaatatcaccgaatgttttccttttttctgtttatccacacaaggtttatatatatttaagatatctcttagtcactaaattaggcttagcgtggtgcctcacgcttgtgatctcagcagtttgggaggccgaggcaggcggatccttgaggctaagagtttgagaccaacctggccaacatgacaaaaccccatctctactaaaaatttaaaaaa

SEQ ID NO: 15177 - DNA, 1263 bp, Homo sapiens
tcttccgtaacccctgcacagagcagattctgaaacttcttgacaatttgcttgcgcttataaggtgagtcagaataatggcttttctctgttgttttctactttaccttaaaaatttcaaaagtttagtctgtttacatgtcttcatatcttagtggtattaatgagggattgatttaagtcttatttctttctagagggtgtctcagttttaaaaaaaataacatcagctctcacttgcataaatcttaatttccatgtgaacccaaggggataatcccaaaagggcttttcccattttgagcctcctctttgttgttcttccatttctttatacttcatccctatttttacttgtaagttttatttggtctaaattttttagtaaaggaattgctcattgggagcagggcagttgccttctataatgatgcttgtctaggtggtattcatatgagctaatctgaatttatcaatactgagtctgagctcagatgaaccaaacaaccgctggctgaacatgctaaacaaaggaattataaatttttcatctgagtttgctagatccttggttctcaaagctgagtcctaagaccagtagcattagcatcacctgagagcttatttcaaaggcagaatcaaggccccaccccagacatactaaatcagaatctgcattttaactagatgcccagtggtttatatacacattaaacattcagaatcactgttttagatcacatgagttaatatattcaagtggaagtaggccagtataggcttatcagttactagatatagatatttgatgactcagggatggtctctaaatgaaaagataggtttttttatataattcagttattggccaaagagtgctttttgtatctcacaggattggttttttttttgtttgtttgtttttttgagacagagtctcactttgtcacccaggctgggagtgcagtggtgcaatcttggctcactgcaacctccgcctcccaggcttaagcgattcttctgcctcagccacccaagtagctgggactacaggtgtgcaccaccactcctggctaatttttgtatttttagtagagacagggcttcgccatgttagccaggctggtctcgaactcctggccgcaagtgatcagtccacctcggcctcccaaagtgctgggactccaggagtgagccaccacacctggcctctcacaggatgtttaaattacattgttagagctctgtttcagtactttttgg

SEQ ID NO: 15178 - DNA, 1157 bp, Homo sapiens
ccattttggtttaagagctaggcccagggtggggtaggggttaaggatattgaagtgtgatggcattatccatgatatctgaagttctctaaaagcagtcttttgtaatttaatctctggttcaattagattgtgggtggggagggcacagagtgagactcctgtggtgtctgcattgcagcaccagcacatttagaaaaatgagaacagctaggaagggccatacaaccacacagacacttatctgtgctcacacagtagagaaattattttctttatattttgaagattatattcttgtttaattcttaaattgttactaataatatttgggagtgggaagggaaatttaaaccttcaaatgacaactgacaattagtatgattatactcctctcactataaaaactgctcttaagggccaaataatgatagcctgttaactcctgtggaagaaactgtccttgtttaaagtcatgatgtaacttgtttttccccctccaaccttcagagtgctgtcagatgttgatgctttcattgcgtatgtgggtacagatcagaagagctgtgacccaggcctggaggatccgtgtggcttaaaccgtgcacgagtaagactttcctgggaatgggaagtggcattggccatgggtaggagtagggtgttgtcttttgtcaagtttctcatagatttgttttttctatactggtgagaaacgtgggagtctccacttccctaagcttctcctttcttttcttctttagtcttgaattcttgagttagttcccacagcagagcagatggtcttttctatgaagtcattattttggctttaaggatctctaaatagctctgaagactgaaggtgtaatgaggaagtaggtcagaacttggtcagcagggtgagtcctccctgccattgctctctggcatgtaaagtcttaagtgatggcttaacttgcaaacctgagatttttcagtgctttgctatttaaataagcattgttcctggctccattatggcacaagtcccattaattaacctggcaagtagtaggttgattcagagtaccgtgaggggggattaggacactagctgtcaaggcccaataagggtcaactcaaagaagatgaagtgatggcattttaaacacttt

SEQ ID NO: 15179 - DNA, 1252 bp, Homo sapiens
aaagatcaagggagcttgtggccctgggctgcctgaacctggccacacaggcttgcggcagcaagagcccagcccatctgtttacaggacgctcagcagttactcccaggaaaatccctgcacttcaggaaagggaaactggtgaaaggatttgcttgcccaaccgtggcctggcctgaggaggtagtgctccactctcccacgtccagcttgggcccccagccctcacaggcacctctttgttctccctccacaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgacagctgtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccaggctggctcccattctatagcatgaagggcaagtccatgttcttctcgccagt

SEQ ID NO: 15180 - DNA, 1220 bp, Homo sapiens
cccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccttccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctct

SEQ ID NO: 15181 - DNA, 1199 bp, Homo sapiens
gcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtg

SEQ ID NO: 15182 - DNA, 1134 bp, Homo sapiens
aaactccggctttctggatctagaacccactttccacaccttgagccctcagtgagcatttgtagagtagctgagtgactgaaagaagtgcagacaggcaggtacacagaggggatggccgagggcctgactgggcagtggggactaggcctgggtttctggactgatttgggggctgaagtcagcagcccagattctgaaggtctctaggctgtggccctgccttgctctgccaaccatctggctctgcacaggctgtccaaacaggactccgttgctagggccctggcagggatgcctgacctgataatccctgcctcccatgggaacccagcctctccccggccatgtccatcaaggtcatctagtgtggcctggctactagctgcttccgaggtgctgcccatctaccctttccttccttataccccctctctgagctgcttctttggaccttctttaataattagtggttaattgtcagtggtctagggtcagactgcctgagtcccagccctggctctgctgtgtggccttgggagtgttacttaacctctctgagcctcatttccccatctttaatatggaaatcagaacagactattgtaaagattggtatgaggattaaatgagctaaaacatttaaaaggctctaacagtacatctcaaactgcatatatgtttttgttaatattattatgtcttactcattcatttaaattgatgacagtgtagccagtgcagagtgagaggagaggtggtcagggcagttaaagtactagcatccctagtccatcttctttgaaaaaccagagctgagtgacagggacactcccttgctctagcttacagtctttcctgggttggggcggggtgggagaagtaccactccccaggcaccctcattccgggaggccctacgctggtgtgtctcaccttctgctgagacagatacccaacatcgccctgttcaatacttaaagctcagctacactttgaccacaaggcacagttttctacttgatgtatttaaatggatttagggccgggcgcggtggctcaaacctgtaatcccagcactttggaaggccgaggcgagcggatcacctgaggtcaggagtttgagacgagcct

SEQ ID NO: 15183 - DNA, 1187 bp, Homo sapiens
attcccagccacttgggaggctgaggtgggagggtcactttagcctgggagcttgaggctccagtgagctgagattccaccactacactccagcctgggcatcagagcgagacgctgtttccaaaaaaaaaaaaatgcttagaggagcagtgcctggcttgtaggaagccccaagtcagcgtgggctggatgctgcaggccccagcctggctttccaactagaggccctgtccctaaccctcccacaaaggtggaggccattgagtactacacaaagctggagcagaagctgaaggaagactacaagcgggagaaggagaaggtgaatgagaagcctcttggcatggcctttgtcaccttccacaatgagactatcaccgccatgtgagtccccaactcggccctcggccctgagcagccctccagggctccctgacccctgtgctcatggccttctgccagcagtgtggcctccaggtgggcctgtggtaaccagtgcccatctttctagcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactggtgagcaaacaggtgtcagggcaggctttccagggcctgggatgggctcagtaggtaggcggaggagagggagtgtcttggtgtcactgggggccaatcctgcccttggttcctggactgaccggttccccaccttgccagggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacgtgaggcctcatgcccctgtcactttccacgctgggtcacaacacacagataccaggccctgatccctcttccacttgcccagcccagcccgttctgcttgttccaaccccgtgccaccaaccagctcccaaaaacccctgtgtgcacttcccttgggctccctgccaccttccccctgagagaggccaccctcaggtgtgcaacacctggagaaacacccagggaagagagagagcctgcat

SEQ ID NO: 15184 - DNA, 1099 bp, Homo sapiens
ctgccctcacacctctaggggtctctctgcagccctgtggtagtccctttgcctactcctctcggtggcctccagaccctccaactttcctcctgcttgtgtaagctccccatgccaggatgtgtgtgatggggcggggctgagctgcctgacactcaagtcaggctgggaatgatcttggtctccacctcatttttccctttagttgaatcagagttccccccacctcccagtctacagggctaactgagaagcagcttttatacctctctccattccaaaaggagcttgaacatttaatatggattctagctcctccactcaccagctctgtgacttcaggcaagtgactcaacccctctgaacctcagctggccccatctattcagtgctagtactagcttatgggtggttgtgaagaaaagacaagagatctgcaggtagtggctagccccatatgaaatcctgggagtggagaattgcaggagaggtgttgggagtctggaggcagggaggtactcaatttggtggctactttcaggggcccacctcagcaggccaaggcatagttggagggacaccagatgctctgagctggtatcagatccctgtttgccgctgggcaaaggcagacaaaagcaaaacacgaaggctggccagctgaatgttaggatatgggcaggaggagagggctggagttgaattgtgcccaagactggtatgggaactcctgagaacagagagagcaggggtgtagcagggggccagggaagaaataaatacttcttctctaagcctaagccagttttacccaggagaacaggagctattctccccaccctaggcccccatctgctttgaagctacacctgctcttaactgccaggaatcttgcctgtggggtggagtacggggtatgcgggtatgaagtaagaacctagaggaagagtccctactacctaatagaaaacctgagacctaggcagggctcagtggctcatgcctgtaatcccagcactttgggaagccaaggtgggtgggtcacctgaggtcgggagttcgaaaccagcctggtcaacatggtgaaaccctgtctcta

SEQ ID NO: 15185 - DNA, 2660 bp, Homo sapiens
agtagagatggggtttcaccaggtcaagctggtctcaaactcctgacctcaggtgatccacccacctcggcctcccaaagtgctgagattacaggcgtgagccaccacgcctggcctggattcgtggttctttaatgcacagccaccatgaagacacaggcatttgggtgactctaccccttctatctagatctcagtcctggctttctctgtctgcttcatcttcactatcaccattgggatgtttccagccgtgactgttgaggtcaagtccagcatcgcaggcagcagcacctggggtgaggatgccacaggtttccaggatgggaacagacaggatcttgagttgggctggaagtggggaagggagggagcctgggtcaccttctccccgtttcctgggtccatttgcccttccctgggctggaagcatcttctccattttactgttggggaagctgaggcccagtgaaggttaggcttgctatacctgcctctgtgagcctgataaccacccgttcatctcctcttccagaacgttacttcattcctgtgtcctgtttcttgactttcaatatctttgactggttgggccggagcctcacagctgtattcatgtgggtaagtggaggaagagggccccaggcccctgtgggaagtaagagtccagcctggacccagagagggaacccaagaaagtatggtagtaaggggaccatttgttttaaagtcgaggcataatttatgtatagttaagtacaagtcttaagtgtacaacttaatgaatatatgtatatacacatacctgcccagatcgagatgtagaatatttccagcactccagaaggctccaccatgcccctttcaagagtaaccccctaaggagaaccaggctttgaggtttcagttcagatcctgaggggccccagatggatccttgggggcctggctgtgccctggggtggcggcctgggctgaggccctgcctggtgcccacagcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagtgagtagggctggcagggaacttggtggcatcagacaggatctagagttccagtgggggacactcagtagagggagggcaaaaggagagtccctgctcccagagctgagaggagagatggctcaggaggggctcccaggctgaggggatagtgactgtagtggaggggggcgccaagcttacttgggtggaggtggagacaggtttgcaggaaggagtgaaagacaaccccaccatacacgttccctcaaggaggagaagccaggttggggttaggcagccaggatgggttgatcaacagaatgaggttcgacagtcaagttgctccaccccacccctccttccacccagaggctctgggctggggtacagccattctgaggtagccttgcccttccttccccgcttaggaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggctccctgtgtcctccagccgtggcttcatgccctggagtgggtagagggctggcagcctgagtctgggagatgagcatgacccagctgggccctggccaggactggacctgggtccaagggggaggaggggggagtagtcctcttggcctcagaggggctgcaatgccccctgctggggccacaggggagggacaggcctggaaccagaacaccaagactgttagccaagactaagaacgggtttttctttgctgcttcattctttctttcataggacagaggatggagatagctccccatctttcctttgtcttcac

SEQ ID NO: 15186 - DNA, 4407 bp, Homo sapiens
tagcttttctgttacaaggtagttgggttaggattttctgggctcacaccagtagcagaaattttgggcatcctgtctgtaaagcagttcttcacagcagttctgctgatacttactaattgctggtctcaactgcatatactttttaccctgttacacgcttgtaattgactcttctaggtgagcccattggcaggggtaccaaagtgatcctccatcttaaagaagatcagacagagtacctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacacacggaacttgtccaactgataacagaaatgtgatagccatgtgatttcacttactgattaccctgtcatagtgaagtgccatcatttctaatgacctcactttctcttcttatggaaatctgggtaatgtctattggcagccttacacatccagggttctgatcagaggggactgttttctacatacagctagtacccatctagatcgtggagggcattaaggctcagttttctcaggagctgcttgttgtgtgtgctctatcccttaggcttagggaggatcattgttccacttttagataatttggtgttggggctaaaaggtcctcttttgaaatgtaccacttatttttggtttctttcagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttgggaggttttaggcattctgctaggatattctaaggtaacagttttctgcaatacatagtaggtgtaagggttcaggaggctattagagccttctgtttgaatctggggaccaggtctggtctagctgttttttactgagctttctcaccctggttgatggcagattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaaggtaaaaaggcaaataatgcttattccctttaccactttcttagtaataacaataaattattccattcacattgaaagtgaagttattgtagttaagctggattgtttttcctcttcccacccttcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgcgttgactctgattgaagcctttttggaggagtggggagcacaattagggcttcctgggaactggcagtatgaggcattttagtcactgagttcatttaattaccctacaggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtaagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcgcaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtaagtagctttggtacttggtgtggcaaggagtttgtgcaactcgtctcctctatggatttgacttaatgctatttggtcaagtctcacatggcttaattttacttcaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagttctgctttcccttgtgaagtggatgttatccttccctagcttcttcatccctccagctcttgctgttttcatgagcacagcaagttgagctggttttgtagtgaaaataacagaataccagtgagtcttaagagttcacacactgaagctaaaggcagtttggaaaaactaccatataataatgccctttcagtcaaccaaaacacaggaccaagtccactgcagtaatttaatttaataaaataaaattataagagcaaaaagttacatttctaaagtaccaaaacctgcaacaggctcatggaacagagcctagggatccaggagcataggaggtggtggtgctgggcagggctctgcat

SEQ ID NO: 15187 - DNA, 1318 bp, Homo sapiens
ggggctggggaccctgacgtcccggatcgtggaggggagtgtgggggaaggggcgcttcctctgacctgagcagccggctagcgttggagggaacagaggagacctgtgtggccagaggggcggatccgcccccggggagggaggaagctctgcctggccagcgccggcgcaccccctccccgagagagagagagagagagaggctctttgtccgggccggagctgcagcggagggggcggggaggagactccgggcactactccagtgtggtcccctctggagggcggaggggatgaggagctgcgccctaatccttatgtccgctttccttacagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtgtgaagaaagggcggggaagtgagctaggtcgggaaagagggtatttggccagcagtccaaacgggatatgacttggagagggcgggaggtcggtaggccggacagcagggcaggctggctgctctggggaagatgaagtgctatggagaagatttggggcttgactttgtgtgctttcttcaggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgggtaggtgggctcagcctctcttcctgggttggatgccggtgggcagggattctgtgaaggtttccattttaccagtcccagagctttgctggctggtgtgtttcgtgtcctcctcccaggggcacactgcacctccatctttgaggtgtttgggggaaatgcccttttgtttcttccttttctcctctccagcactggtactgaaagttcatgctgttatttcaagatgtctagtgcagaagagaggactcctcttgccctattctctgtgatttctactgtgccgttattatacttccttcctgcactggtgtctcacatactgtaaacccactgataaaattgtgggggagccattcagccttcccccagtactgcatgtgagagagtgctaacatgctgaccccatggcattttgcagtgggtactagttccacctt

SEQ ID NO: 15188 - DNA, 1200 bp, Homo sapiens
cagcactttgggaggccgaggcgggtggatcacgaggtcaagagatcgagaccattctggccaacatagtgaaaccccgtctctactaaaaacacaaaaaattagcctggcgtggtagtgggcgcctgtagtcccagctactcgggaggctgaggcgggagcatggcatgaacccgggaggcggagcttgcagtgagccgagatggcgccactgcactccagcctgggcgacagagccagactccatctcaaaaaaaaaaaaaaaaaaagaaaaagaaaaagaaaaaaaatttaaatgcgcacaggtagggctggttctagtccggtcatcacgtctgattacacagagggcgtcagttgccctgtaagtcagacggaaagatcctaaccagctccagccggcacctaaaccaagacagacttagggtccgaccaggcaaccagagcacagatggggcgggaaagggtgagtgggcagaagcgggcaccaatgacgggctccccgcgaccccgccgcctgccccccgcgccgcaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccg

SEQ ID NO: 15189 - DNA, 1186 bp, Homo sapiens
cagcctcccaacaggggcctcctcacctgggttctgagtgtataccccttttagagagtgagatgccacccgggcagcactcgttaaagctggccagcacgagtgactaaggggagagagcatgacatagacctgggtggcaacggggacctctggaagcaggtgggagtaagagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgcgaggggcccaaattgtggggataccatggcccatggcttctaaagggtttagctttactttcaggtagagatggctgagtgaggagggagaagaggctagagagagggaggcttgggcaggggaaacagctgcccaccaggttttcctggacagcagtgcccacctgcctactagcactgaacctgcctggaccctgagtctgtgctccttgggggcctggcgtttggagcacccttctttcctctgaatggacatctgtgaggtacaggtggtgagctgcagcctcaggctccatttcttagccagctggcacctggatgtca

SEQ ID NO: 15190 - DNA, 1148 bp, Homo sapiens
taattttggatcctgggataaatgaaaaatgacctctgtggacatgaagaaacattgtattattcagctagtggcaccaacgttcgaattagtgatctctgaactccaagttaccaaaatgttaagatagtaggatattaaacttctaaaattccacaaggaatttaggaatatactgtaggattccactaattgtccacatttctaatacgaggcactcagtttggttagttttgttttgttcttaggcattttggtctcaaaatctaggcaggtaaacacattgtttacaggacttgacttggtgaagtattttagagttggagtccttcaagatcatgtctctgtcctaaagaggcttttctttcctggctgggaaatcaggagagagtacttgggtatataattacctctacccagaactgagccacatgcctgatgcaggatggcgcacctttttacggggtctacgagccaagttcccggcacactctgggagaggatgtgggagcccatttgagatgactggtgtccttcccatgctggggagccccaagaggtactgtggcctgatgccaccctcaggaatggggaggccactactgactcacctgggagccaacactgaggctcctaaatccaggctataacacttacatgaaaagtaaacattttgtggtgtgcatgaagggtcctagccttatatcaaacaagcagccaaaatatcccaatgtcttattttctgaggaaatgtgtctgcctccaccaaatgtggtgtgggggcagcagacggatccagcttccagtggtgaagctgtgagcaagggtatgcttatctggctagaaatgtgttcttttgtctgagcacagtttgggctggagtaaaagttgggattctgttagacagaatggatttaggggcatagttatactaaatattgtttgttctttatttaaaattcatttaaatgggagctctgcatttttttttttttttttgagatggagtgtcgctctgtcgcccaggctggagtgcagtggcgccatctcggctccctgcaagctctgcctcccgggttcacgccattctcctgcctcagcctcccaagtagctgggactacaggcacccgccaccacacccggctaa

SEQ ID NO: 15191 - DNA, 1198 bp, Homo sapiens
tgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccatgatgtataacacttctaatgtgatgtgttagattgatagaaggaatggaaacattgaaatctgccatgactggtattcattttctctgttagctttcattgagaaaatgagtaaggattctgcctgcttcaagattggtatagtaggaccagaagagattctgcaagtctgtctaaacttttaaacttgcttctttgtcttcttgttaatcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggtattgtaaatgaacacgtttttattttagaaaaacttgaattcaaggacttagcatatttgctttagtaatgtttacggagaatgactacttattgtgttggattttcctctttgatttcttcttcatagtaataaataatagtgtccaggaaatggttaaatactgtggagtgcctccccccctttctttaagatggagtctcgctctgttacccaggctggagtgcagtagcgcgatctcagcttacggaacccctctgcctcccgggttcaagcgattctcgtgcctcagccttctgagtagctgggattacagacatccgccaccatgcctgtctaattggagtgttcttttgcaaagcttcggatcctatcacgttatttttgaatactttgtatttgattttagagtagattgattcatttttaatgattactttgtgaattttattatgtaatccttttatgtatgtattactattgctttccctccagcattttattatgaa

SEQ ID NO: 15192 - DNA, 1160 bp, Homo sapiens
agagtatcttcagtgatcacaagtgaaagtttttggttggtcttaatgttgggaagaaggggggatagaaaataaacataagacttgtcttagctctgaagtcaggattatttttctagaattaatattaggctgattttttttgagactttttttctctttctgtaatttttaatttttgtggatacatagtaggtgtgtatatttatggggtacatgagatatcttgatacaggcatgcatgtgtaataatcatatcgtggaaaatggggtattcatcccctcaagcatttaacctttgtgtttgaaaccatccaattattcttagttattttaaaatgtacagttattttgactagagtcaccctgttgtgctatcaatttttaagagactcataaaatactggtggaatgtttaatatgcatgaattgagaaggaccacttcttttctacaggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggtgggtaactgtactgaaagaagcgtgagtttggctgaatgtgtcagtaggctggaagaatgaagaatagccattaaatgtcccaagatctctacctagtcctttttaatattgaaaaaacttctaaagtaaataacttatgtcattaataatgtatcctcacataattaacatactcacaatattttgatgagcattcttaaaaatatatatatggaaatttaaatacattctgtcaaattcattatgcttctctaaaatacacataggtagtcttttagacattgcttcaatctagcaaagaaaagatgttattggttagtcttaaaaacaaatacatcttggttcctgggtggtgcgatgtacgagcctgtagtctcagctgctcgagaggctgaggtgggaggattctttgggcccaggagtttgaatccagtccggggaacatagtaagacctctatctaaactggagttggaaatttagatagagtgtgtcaaaataatattagtaacactttgtactaatatatcttatacg

SEQ ID NO: 15193 - DNA, 1135 bp, Homo sapiens
tttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaact

SEQ ID NO: 15194 - DNA, 1843 bp, Homo sapiens
accggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttacttaagtagtccgagtatatttaatcgttgaatttcttgctttgtacatgtcctctagttgtgactctttgattagtcttttgcaaaagtatgtgtgctctaaaaacctcagctattctaatctgtaaatcgtggaaattagcaaagatttcaggcagggcatccacttccattttctcactgaaagaggaacttaaaattgctaaggtctggttgttggaattctgtagagccacagttcccaagcaaagggagacatgcaatgaatatgatatgatatatgatatgctataatgtattctacaattctatagatttgtgtttggaaaggtacctggaggttcgtagggaaggactttagtgaaaactaccaagcacttcctagtcttttggattaagtctgagaattcagtttttgagattgtccttattataggaaatgggtagatacctcattgttcctgaataagttcagagggctctcatggtcttgaggcagggtgagatctcatgttgat

SEQ ID NO: 15195 - DNA, 1141 bp, Homo sapiens
tcctggtcggatctttaacaggaatgatgatggtggtgctggaattgttggccctttttctgctctgctcctatgtaacatcttcttggtttttgttcctttccctccccttctgtttctttcagcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagtggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaataatttagatgtttaaggttccttcca

SEQ ID NO: 15196 - DNA, 1269 bp, Homo sapiens
gggtaactgtaaatggaaactttgtttaacagtattatctttattctatcttaaaatagtttatgccatttttttctattctagcccttaatcctacagtcactgggacccaaaactcagagtgtggagataacaaaaacagataccgaaggtaaaattaaaggtatgtttttgaataaagctttcatattgggaatagtagaaacatactcaaatgtattaagagacttgttggaagcatttgttacactgtcttattagaatagcaaattctattagatgtaagcaccatgaggtcaaggattttgatatactttgttggttgatggatgtatctccttgtagttgaatctgtgcctggaacatcacaaacagtaaatatttgaatgaatggattaatgaaattgttacttaacatacggtattgactataagtattttaaaatttaaagataattaagttcatctctaataacttttagtatactttacacaagatagaggctaaataagtatttgttgaatgaatccatttgtgtgagccacattatttacattctttatttcagctaaagaatattgtagaacattatttgcctatgaaggtactaatgaagatgaacttacttttaaagagggggagataatccatttgataagtaaggtaaggtgtttctgtttttcagtgaattgcttaatttatttatagaaatatttttcaaaagttatacattcaccctagagtgttcttatattcaccctggaatctagaagagctgggactttgtcttgtttctaagtcctgaaaacttggcacgtaataagtgctcagaacgttctctttttgagctaacttttattgactatatttgttgtaatttacatattgggaattattgttaaccatcatatttgttcttttttaagtactttttttttaaaattaacctcaacttcccaggtttttattcttacttctcttccacctcattctattttttctcctgtctgtcgtttggagtgttgtttgtaatgtaaacagaagaaaaatagggaaacaagctaaacatccatgagtatggaaatggttctgaaactctttttactctggaaaatgatgtcaccattttaaagaatgaagtgattttataacttggaataaatcctaatgcaaaataaagagaaaacccagtactacttgtgtgtgggcagaatcctataataactagtattatgggaaaattacaaatattttgtttttgctataac

SEQ ID NO: 15197 - DNA, 1266 bp, Homo sapiens
cagtctattgaaattttattaaagtgactttctatttttttagtgaaatagttaaggggtgtcaggctatggactcattttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatggatttttctttcttccttttttcttctgttaataaaattgtcattttctacaaaaaccactaatgattacaaatgtattctttagttgtctggtgatttttccagttgtgaacatcaaattgcttttgaatttccaaatttgccacttatcttgaagtacttaattgtttttcttcttgctgttaaaatctttcgaacgtaaatataatattaaataaaatcagaaattttttttttacgttttcagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggtaagtagcccttcttttctcctgtgagtactacttaacccatgcataaagaatttttttcaaaccatattaagtaaaaatctaatctgtggctgggtgtggtagttcgcgcctgtaatcccagcactttgggagaccaagtttggaggattgcttgagtccaggagttcgagaccagcctggacgacatgacaaaaccccatctttgcaaaaaaaaaaaaaaaaaagaaaagaaaagaaaagaaaaagccaggcttggtgacacatccctgtggtcccagctactcaagaggctgaggtgggaggatgtcttgagcctgggaagtcaaggctgcagtgagccgtgaacatgccagtgcgctccagcctgggcaacaaaaccaagaccctgtctcaaaaaaaagtctctggtatgagcaagtatattttcaaagaaattttcattaacagtccttttctctttttggcaaaaaagttaaattggtgaagttattctagtagctggattgtggaaaacgtgcatacataaccataattttaggctagaaatcttctggtcggatatgattagtttttaaactacta

SEQ ID NO: 15198 - DNA, 1098 bp, Homo sapiens
attctttttactgttgtttatgtatcctttgtttaattatagatacatgtacatttcttaatttggtttcaaggattcttttgttctttgtaggactgactgatttttttacagctttaattttaaatgctcacatgacttaacatttgttctggctgaaagggctataattgcttttttcttattgtaactgccatttaggaacttgcattgtactgttgaaactttattcaaccaaattatagcatgggaaactggattttaggtctggaaaaaaagtctgaaggcttgaaagtatgatcacatcttaatgacatagagtaaaataaactactaaactaaggatattttatgtttgctcaatttatgttttttgttttagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaa

SEQ ID NO: 15199 - DNA, 1189 bp, Homo sapiens
ttgttggtcattttctcaatagtacatgaaatcaagatgcttatgagcatggaaatgtatttaaagtttttgcttgtgtcctcctcagtcagaatagaaaagtaactgaaatacttttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaattttttttctacgtgtgagtataaaagacaaaagttgaacagcatggaatctcattgccaaattattagtgaatgtatagttcaggtattctttgagacacacagtatcattaatttctgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgccagtcgtgtcagtctttattggttattttttgttaactttagcatttgtgtatttcagagtatgatgaaaattatattacttcaatttccaaatacaagaataaatagtaaaccaaaaacattaaaaattctagacccgtatgacttttactgaacttttctgagtctggtttttcatctgaaactgagacagtaatttctact

SEQ ID NO: 15200 - DNA, 1172 bp, Homo sapiens
tcacaaggttccacaataggctatctgcaagctgaggagcaaggaagccggtctgagtcccaaagctgaagaacttggagtccgatgttcgagggcagaaaatatccagcatgggagaaagatgtaggctgggaggctaagacagtctgggctttttacatttttctgcttgctttatattctggccaagctggcagctgattaggcccatcccaattaagggttggtctgcctttcccagcccactagctcaaaagttaatctcttttgacaacatcctcacagacccacccaggatcaataccttgcatccttcaatctaatcaggttgacactcagtattaaacatcacagtaagtatgtcctaaatgttgcatgggacatatttatactaaaaataattcattcattgatctaaaattcacatttaattgggcatcaaatattttatttagcatccttattagtcagtctcctgcaaagtcgacaagtactgtatttctgggagtcctccctttgccaaacatgtccgtttagcagtggacactactgctgtagtttcagccatgatgcctatcacatatgcgcttggtattggagaggaagaggaactctgattacagtgagtgtgactgaaggcacaggattagctttcatgctgatatactcctctgcagtttcaagaatgaggacagcagctctttaaggataggaaagaagaaatttcagaccttcactgaactttctagtttgacaggaagagctatatatatatgatatccttgaaatatcctctggttcacttaggctaaaaagacaatttagaaatttcccagaaatgcctatttttcacagtcaaacatggctgagatgccaaatagagtgttgttggaaagtcaccagattagaaagcatacccagggacaatatttgacacttaagtggcagtcctgtttatgagacacacatttaagtttgcaacacatttatggaggaaaattaaacagatagtgaagatgaggtatatctgcttctagtaaaagtcattttttaaaaaacctgctagctacgtttatactatgtaagaataaagggaataatcactgagaataaagaaattgtgtatttttaacagatattttggaaagcacttgtaatgtttattatattat

SEQ ID NO: 15201 - DNA, 1343 bp, Homo sapiens
atattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 15202 - DNA, 1151 bp, Homo sapiens
aacaagtactttttctttggtctcatttattactgtatcgctatagtagatatagagatatagtaatatctggcacatattaggcacacagctaatgttggatgagttagtgaacaaatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttgtttacatttttcattgcttgaataattataaaatcttaattttcataattgaaa

SEQ ID NO: 15203 - DNA, 1190 bp, Homo sapiens
ctttccctgtcctgtcaccagactcttcagactgcacatgcaattcaggcattaatgtgatacttgtaatgattcctacatttttagttgagaatctatggtgtgaaatataatgttggtgttgagaataaacttacattttcattaaaaatgttcatatcttaatgccccaaaatgggccattcttcagccttttgtggggaagaggaaagtacctgatgacatgcatttgtttataggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaaggtaggatgttttattttatctaggcagtgccatttcatacatccatgcataaaatttttaatggcattctga

SEQ ID NO: 15204 - DNA, 2135 bp, Homo sapiens
ggaagggactttgttcccttggagagggtgggaaacaaactgctggtcatcaatagaactcaaaactagaggcctgcagcttttaacattttatattctcatttaatttcaaacttactgaaaagttatgagaaaagcatgaagaacttctggatgtcctttacccagaatcttcagttgtttaaattaataattctctctttctgagagagaagagttttacaataaggataaaacttaatgtcttactgtaacctcagattcttcttggtgggatagatacattttggccatttgtttttgaaatgaagaatttttaccaccagggttttaggaaacatttttatctatgaattttgtttactggacaccaagaaactccatagccaagttttacgttttttctttttatactttaaacacataatacagtgtatttactgaaaaaaatttgaaacacattgaaaagtatttagaaaaaaaattaaaatcaattgtaactctatccctcaaggacaaccatcaactgtatcttaaaatgcttgaatcagctcgtatagatctcacttttttttttgagaccggagtgcagtgtttattttttacttttttacagtgtttattttttactttttgtagagacgggatctcaccatgttgcccaggctggtcttggactcctggcctcaagcagtccttctacctgagcctcccaaaaggctgggattacaggcataagccactgtgcttgtttgatctcattctttttaatgactgcagggtttccatggtatggatgggtaaaaatttaatgaaattctctgatgatagacatttgggttgttccctgtttacagtaaaacagtattaaatttatcagtgtgcactcatgcaagtatagctataaggtgagttcctagaaatgggctccctgggccaaaggatatacgcttttaagggtttagtaagtgctgttaaattgtcccgcattgacgctgaccgggttactattttacagtgaatgggaatgccaatttcccacacgctagtacaatagtttagctttaaagggggctcctcaagggtagcactgccatcagaggcagatgtgtgtgtgagaaagaatattgaggggacgcctctactgtattaatactatggattttcctagtatagctgtttcctgagagcatttgggtttgtttactcctcttccccctttcttctgtctggggcaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaatagtcatagtgtgttttttatacataacattgaattgttttccttgagagcaatcgtgcagggtttgctgctcccgcatttgcagcaaactaccacaaggtggcagcagcctgctgtga

SEQ ID NO: 15205 - DNA, 1099 bp, Homo sapiens
tagttgaggttttacttgtatcttctgagtaagggactccaaaaagttctaagtgcttgtagcctaaccaacttgccctgtctttatgacaggtaggggaaagggatcatctttcagagtcaggtcctgccttgggaatgagaagagcagaataaggtttgggaagcaggggcctggttttcagacctacactcagcctgttagaggttcctgtagtagaaagtggggcttcctaggaagctcagttaaagaagggttgcaggtagaagagatgatttacattgtttaatggctttaaaacacttccctttttcactgctttttgtctgttttgctctttgaggtcaagcctttcattcccactcccagaactgcagcagccttgttgttctttcttcctattgatgtcatgtccacttctgttgtcctcgcattccccagtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatggtgaggccataagaatagtaagagtaactaatggaaaggcgctaaacagatggtagtttctcaggcccaacccaggtggtggtaggtgtttcagtgtccgggttgatgttgaagagccctcaactgtttagccacctccccttcttgcttagtggagggtatcctaaggtgtgtcttttgtccatttctgggtctgggaataactgagcatcttgtgtgagccaggcagttccactatctttatttgtgggttccatgtgtctgattctttttgggccctttctttatgaatcttggtgtctccccttcttgtgctatagaagaagcaatttcccctgggttaaactctttattactctcctttctcctaacttgggtataccagctatgcccttgggtagtgctgtggatatcctggccacagatgatcccaactttagccaggaagatcagcaggacacccagatttatgagaagcatgac

SEQ ID NO: 15206 - DNA, 1100 bp, Homo sapiens
ccagctgggtggctgtggaagtctgtgaggtggcccaaccacaagcatacctattaagagaagcccagagcttccagcccccacttcgaaaactctcctctggccccacatagcaaactccttctccgttattttccccacccccagattttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgct

SEQ ID NO: 15207 - DNA, 3634 bp, Homo sapiens
ttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggcggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttcccccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggccttcgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtagactttttgtcccaagcagattgcgtgcgtgcgcctgtgtgtgagaataagtgccttactttgctgtgtggttttcaacttgtactccgtggccagcccccagttgccagggctcgacggcagccaaggacaccatacctca

SEQ ID NO: 15208 - DNA, 1202 bp, Homo sapiens
atagagcagggaatgaggagaacagacaaggagaaatgaggactctgaaatagtctccttctgggggaagagtgttgtcacgatggtggagtcactgcccaagggagattggagcgggagacagcagaatgtagagccacatcctgaatgtgagggctccacactgcagggcctggggcagacagaacatgcggcggcaggtgctaagcccttggcccatgtggaagaagcaagctgggtgggtagtgtagacgccacagtgatgtggatgagaagagaaaatgggaggctgagctccaactgaggagtgagtacagttacacttcttactatctcattcattcagataatgtggagaaagctcgggatttctgcatccatgcagtaaggcaacagaggtggggaaagtcagggtggagaggctctgaaagaagcaggggtcccagcctgggtgggcatgtgttcctgatctgattcctcccattctccaggtcttaaagagccacggacaagactaccttgttggcaacaagctgagccgggctgacattcacctggtggaacttctctactacgtggaagagcttgactctagccttatttccagcttccctctgctgaaggtgacccatttcacagtcttcagagaggcagacccacatctcccatcttgggatcttgtatctgggccctgggactgagcatgttttgaccccagccttctccaggcctttggtgccccaaggtctccaaaatgagcttccaggctccaattttgaggaatgaaaacacttttgttatggaaaggaaatttgtagtgcatgctaccccgcaaagagtattttgccttttattatggaaaggacccagggcccagcatgtctccccatccctctatttcagtgtggtttctgttcctgagttctctgtgatgtcctttatcccatatgtgcccacattgagtcagtctgagcagagccctttccatctggtttcctccctgggctccggctcctgctgtcagacattttgttcctctctgcccagctctccagcactctgcccccgacaatgtatctctcactgagaaaaggtggtcccatggtttgtctttactattttctataacattttcctttccaactcattttcccatattttcacttctgcttagagactgatctgtgctgatatcaaacaag

SEQ ID NO: 15209 - DNA, 1178 bp, Homo sapiens
ctttcttatttcaggcatttaaaataagaatcagcaacatccctacaattaagaagttcctgcagcctgggagtcagaggaagccacccccgatacccactatgttgaacttgccaggaagatagtgctgctctaatggcagcaggttgcgtgatgacaaacatgatgatccagtcacagcaccagcatgtgctgtctgcagaggataatagaagcaaactgtagatcccaggagcaaagtgtctgaaaagaacaaaaccatgctgccattaacagcaacgctgattaaatgtagtataaaatcattcagatgtgtgtggctttttaaagtctgtcagttgtggatgatagtctacaacttttatgaaataaatgttctgtataaataaataggagccagatatatgtagggcaggggcccacatataaccctgttcttctgtctgcatcaagattgggaccattgagggaacagggaccagcaatttgcagggaaggatctctccaacacccaccataattgctgagtacttggggtaagaaaaaaagtggcaaatgacaaattaagagttagacattggctgatgctagtaaatcttacagggatgtgtggggaacagagaatgttcattctgaaaccctgaaaaaaagttggatatttagacaacacttttccacctaacagagccacccaagactgaattttgctatgatgaaacaattccaagtagcactgagattaagatataataatataactgacaaatactacttatacaagctgaacaaaagactccccagccttgatacatttttttttttttaagatacagggtcctctgtcacccaggctggagtgcagtggtgcaatcatagctctctgcaaccttgaactctttctttaagggtacctattatgttctaaactgtaaaatttgaaactcagcctcatgttggggcttgtttgatgggaggcagaagagctgactttgtcgcagagcatatattcaggatgatgttgtaggcataattgtagttcctggtggtctctggtctgaagcaaggtctctgatctgccagtggtttggggcacacaactctatcagcttccaactcctgctgggacattccatcccgggttgcacactttattaacagctgagtgtgtatccaggtat

SEQ ID NO: 15210 - DNA, 1114 bp, Homo sapiens
ttgtgccagtagtcccagctacttggaaggctgagacaggaggatcacttgagcccagactgcagcgaactatgattgtgccactgcactccaacctaggcaatagaatgagatgccgtcagtgatatttttcccttgagtgacagtttatttttgcaaagttatctcagcctataatccagtttgatattttaaaagaaattttctctctagttaaaaaaaattatgaagaacacctttgaatgatttgcaaagggaaatgaatgtagtaatcctatgagaagttcgaaggactctacattatctgtgggatgaatgcataaagcctttggtgccatgccagactactttttaaattataactattttgcagagagcaatacaattgcaaagaataatacgaagcaaacttgcatttggatttcttctcctctactgtctctataggcttctttcatcgagacttaaagcctgagaacctcctctgcatgggaccagaacttgtgaaaattgcagactttggtttggcccgagaaatacgatcaaaacctccatatacagattatgtatctaccagatggtgaataccatttttctcaaaattatttaattgcacttctttaaaaagatatcattatgctaaggataatattaaagtcacaaatgttaacttttcactaagagaaacagtgcagtctgaaacatatatttatagatatgttggtaatgtacaaggttaaaaatcttgtgttctaaatcatgttaaaagaaaacctattatgcttttctataatgtaaataaaattttatatataggccttcctgaggacagcttaacaaaagaattatgtaaaatattctgcaaagacctgtctgagaaccatctaattgctattgtgaaaactttgagacactgggaatttgatttaagcagtttgccatgaccaagtagtctacacacaagttgtaggttttttcctccctcttcctttctctcttagtttttcccttccactttctcttttctctcttttttcctaattcttactttctctgtgtttctcaaagatgccatagagaagtctcctgtagagaaatgctcagtagaaaatat

SEQ ID NO: 15211 - DNA, 2435 bp, Homo sapiens
gacaaaagatttagtcaatgaggacttgacctcaggagtttctccttgataagatttgatcttgaaactaggcctagtgttagggatgcaattctcagtaaagttccctataaagaaaactgtggtcatttggttctcatctgcccttacacattttagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtgcctgcattttacattttttgtgctggcaattctgaagaactggagaaaaatccacttaattcactgtctaggaacttacacaaatggatataaataattcagttaggaaggccatattattgcttagttctcaatgaggaaggaccctgcataataaggcatagtggtggttccaccctaatgctgtcccctctgcctcctccaggtaatcccactaaaggttccagctctaaatatgctcctttgtccttcctccccattggccccaatctctccccttaccctgagaatgttagaattactttcctaggtctagaccataggtcttctgcaaaatttttttctggaaagaaccagttggaaaatatttcaggctttgcaggacatacagtccctgttgcag

SEQ ID NO: 15212 - DNA, 1206 bp, Homo sapiens
tagtgccagtttcactaacgtggctaagcagcacgttttctgagtctgcatgtgctggccacacttgccgactgacacacagctgagatggaggacttcagagttcaatgactgccatttcttgggttttatcaccctatgtgtaatctggtatacctggttaataaatccaattaatgggaagtgtagccttctccttgttttcttcttaagttctttggaaagaatatttgtattattattttactgagcaaaaatcatgaataatacattgttattcagagcatgtaacaaggagcttcaccttgtttgatatgtattgaaaatccatgcctcctctcctgattgctttattggaattaagaacatgaataccaggtgacttttatatcatcatggttagagaaattttttcaacgtttgaaaagttgtgaatgtttttatatatcattaattttttttaatttttcagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgaggtaagtcaaaggttaacacagtcttcctttcacataaatgcactcatattgctgtcctaaattgtattcctaaatgaggaaaggtggccgcttggggtgtagagacaactgggcaagcaagtatcttaatgcgttatgagtgtgttttaaaatcgatttttcaaaatgtcagagttgtttgtacaagtatgccttctagaatatctaaaatagaagcctttgttattgattcttctattatgtttcgtatgatattcaaaattaaagtattttcagaaatactctcatgcaagcaaaatacagagtggaaaatgaacaaaatgtgaaaaacacatgtgaaagcattttattattaagcatctaataagtgcctgcttcttgtttgaaggtaggggaggaaggaagtgggtggcacttgtgtttggtatgttttgtggcacatcaccctctctgattggataacttgtcaaatctcagttgttttttaaaagctaagaggagtgtgactggtgagatctgcatttaggttttgaattgtctgtctga

SEQ ID NO: 15213 - DNA, 1111 bp, Homo sapiens
atttattttaaagttatttgttgccatagattctgtctttgctcgtaatcaagtaagtgttgttgacaggggtaaaataagggagaacagatgtagaaataagtatgtgtcagtgacaatatacacatatatgtaacacatatgcacaggaaatccagtgcttgacctaggagggctgaattgactctatagcttgcagctaaatgatggtatgcctcaaataagttcctttaacaagaaagtgagaaatgccaaaactgatgagtgtgatagaccacccccttctacttagtaagaaaggctgggaaatgtgggcatagaaccacaagcactgtatccacatgtgtatccaataaataacagcaggcacgcgtgggctcaacattcaaacaactctaattgtgtattcagacattaaagagtaatcataggtcaaaatttaaaattgcctattagaacatgattgctctttgacactataaaaatgttgtgttactgacaacaaaagctattatccatgtgtggaaagaactgggaatctgtttatttatctagccaagccaggattcttgaacagactaaaacaagaaagcctgaaggttacagatgacaaataactcagaacacaatttatattgatccttcttttcaggctgttatccttgacaactgttgtactcctcttaatacatctaccatgtgttcttagactgtaaactccagtgggacaggggaatttggtaaacacctggatcaatatagaatatcagtaagtaaaattgtttcaggtttacaaagtttctcacgatttaaaaaaacaacaacactgtatcttattatcctcttgagcaaatgtgataaaagcctgttacaagatagttttatttctgaaagccattatgttaaagaattttctgtcatgagataatatataacacatcacatattccctgaaagaagcttttaaaatgtggagatgcagcattgctatgatataaaaagttaataacttatagaggttcttattaaaaatttcattgtttcccttatttgattctttaatgttgaaacataacattataaaagaaacaacataaagaaaataaacaat

SEQ ID NO: 15214 - DNA, 1960 bp, Homo sapiens
gaagccgaaacttaccttgtagttggaaatctagccttttctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatacctgattatttaaagtgaacttcttctattatttgttttaaataaaggttatatgtatgatatatgtttactaagaaacaaatagggtaaatttgggggacatcaaaaacagggagttataataatgttaaccactctttcaacaaatatttctaataagtattagccatgcaccagccattgtaagtgacatgaaactataaggttcctgccctcccctcttcaagagggaatcagttaataagtcactaaaaagcaagggatgtgtggcaggattacagatttaattaaggtaatatagtagtattcttctggcctctgtacatttaaaagtcaaattgtaaaattttcctgaatatgaaaatagtatcagatatcctcagaaggatggcaggttgtaactttaggtatgagggtcccaacattctgcataactttgtgga

SEQ ID NO: 15215 - DNA, 1129 bp, Homo sapiens
ctaatttttttgtatttttagtagagatggtttcaccaggttggtcaggctgatcttgaactgacctcgtgatccgcccacctcggcctcccaaagtgctgggattacaggcgtgagccaccacgccctgccagtatcttagctttttacatttctactctgtgccacatggagtaagcttacctgatccttcagagaatgcatatttgaactcaaattagaaagcaaaaggaagcctgagtgattgacatgcatctttaaattctgaagatgatgaacatcatcgtgggctctcatgtcctcctcaagccagatcttgatgccactaatggaatctaaaaagaccagaagcattatgggtctagctcaggatgatcctaattttcatttaaaatttatttattttacatcactgcaattattttactaagttggaggaaattcagagaaatttctgtttctctgacaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccaggtaaaataaatataatcctaactcctgttaaccattatctcagatattttctttctttcactgctgtacttctcaaaacattgctttgttctcgttattttcacttcttcagactcctcagctccttacaactgtgtttccaactctgcaactgccctaaaacctctctttacaggaaccctctgtgacctttgcaaaactttccttctttgtcctctgtggggttacactcgtggtattgtctcacgttcactcctgccctcccttttgccttctaaatgtcagctctccttactccttaggtgttatcctcagctctctatttctctcactctgttccctcttttggtgatctcacccacctccacctccctggcttcagtgggtacaaggtacccacattaaggtatccacattaaatgtggatgcattatgttcacattgcattaatcaaacaaggtttgattgctc

SEQ ID NO: 15216 - DNA, 1123 bp, Homo sapiens
gtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaaaaaaaaaaaaaaaaaaaaagcaaacccagaagcttttcctctaaggtgaaagacaaggatttaagcctctaaaatttgacattatgagttagtacctaagatattatgaaagaccaaggagtgttataggaataaaagaccatctgccaacttcctatggaattccctgccattatctctaagacatccgtggtacacacatcaagattgcttagtcctctgttaggttcttagatacatctcttagagtagtgccaaagccagcatccacttgacattcacactagtgatttgagagaaattgggacaccatattaaagaatcattaagaaaaggaatttgttgcattgttttatgaaattgaaataatgaaggctggctgccattatttaaatccaatatgtcattttaaaataagataatcttatcttgttttctcatgagaatgtgacaggactgaacaaatttatacaagactcttcttgatggtgctcaaataggagcagtgtgtcatttatcttctgaagatgctgccagaaatatggttattaaactgtaggtcttagatatctttacatgatgttatgtgcacatatatatctcaaacagtatgtgttgctgttttggttttgtaattaaaattaatttttcaaaatatggtcttcttaggccttccaaaaagagttggggaagaggaccagcagtgtgcaggccctgaagcgctcagcccgagaactcatagaaggcagtcgggatgactc

SEQ ID NO: 15217 - DNA, 1179 bp, Homo sapiens
ctaggggtttgaaggcgggggcagggcgtgtctataaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcg

SEQ ID NO: 15218 - DNA, 1180 bp, Homo sapiens
tcctattgaatatttataaacatctactaggtgtaagatgataatgagaggcctacaaagacaatgtccctgctctataaaagcttatgattgagttgtgtagaaagactatacagatgctcctcaacttacgatgggtttttatccccataaaccctctgtaagttgaaaatacggtaaataaaaaatgcatttaatacacctaacattagcttacaataggacaagatcatctaacccaaaacctgtttctataataaagtgttgaatatcttaggtactttattgaataggtgactgaagtatggtttctactgaatccctatggctttcgtaccatggtaaagtcaaaaaatcctaagtcaagtcattataagtcagaaagcatctataattcatctccatttattagggatgcctctgttaatgcctcttacctgtttattagtcccaagaagaaattcgcatttttttcttgttaaatatttaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaaggtaaaatgttctttaagacagtttggttactctgtagacctctttcaaatacacagtaatggtgctttgcggggacatttcgggaaccttaaatatttcctttgcctgaggaacttctgcttgtcctaagtatcccacacacatagcacttgcattgagaagtctttgctgttcattaatttttaactactcattacaataaaaagtgatatcattgtccaagcttctgccatctcagacttgactacacccactgcttctgactcgtcttcccatgtccacttttatcacttctttgacttaatttctacataactactggatagtcttttaaaaatgtaaatggaatcttgtcattcccctccttcacaccctttggtgacttactactgggcatgcattgaaacacaggcttcttaatgtgacgtgcaaggtaccactgatctggccccagcatttctttccaactccatctacccctttctgatctccctctttctcattacatttccatgaaaac

SEQ ID NO: 15219 - DNA, 1196 bp, Homo sapiens
agataggattctcttttcagacaccaggcttttttttttttttttgagactgagtctcactcctctgtcgtccaggactgtggtggtgtgatcttggcttacttcaacctctgcctcccggttcaagcgattcttgtgcctcagcctccccacaggtagctaggattataggtgcccaccagcatgcctggctaatttttgtatttttagtagagatggggtttcagcatgtttgccaggctagtcttgaactcctgacctcaagtgatccacccacctcagcctccaaaagtgctgatcacaggcgtgagccactgcacccggctgacagcaggcctttttaaagtcaaaagcatgcatttggtatttcgaaagctttcgtttgtcctttaaaataatttcaggtttatgacaccagaagcatttttaagattgatctgattttcatttgtttctacttatttcctttttttctgggaaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcaggtaataaccctttagaaaaattctctgaacttgtcaataaaccacttcttgctgttgaaatatatgttatggatgtacttttatcacaggctgtattaggcataacaatcatggcatggtgccatggtggttctttcctaaaagggctgtggcctcagtttggatgctgacatcactttttgacctggcagcaatttcagcccctggggactaatcttaagaagactgattatagcttgacttcatagacaggctattatcattgaggcccagaaagaagctcagaatttttttttattgggtttgttttctttttctttgtccttttgacctctgttctcataatcagagtgagacatcatacttcattgtattgctaccttttgtttagttcctaagccagactttcttcacaagctatcagtgctgagagccagacatgtagccctcccgacagctttctgaaggggcatattctctgtctgagttggtcggcactccccacct

SEQ ID NO: 15220 - DNA, 1143 bp, Homo sapiens
aagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggtgagtaagagaataaattctgaaagtttttatagcattcaagaccaaaatagcatggaattcttttattagttcacagactcctgtttaatttttataccttaaggagaggagtaaaaataagtgaaataaagaacagaacagcagaagagaacacagctttctagttcttagcataatactcttatctactagagctctcctgatgaagaaaggcaaatctaatggtacctggctgttcttaagaatgcatagagaggcttagcaggctgggattgtttgaagcttatttcctgcttgaaactgacagtgtttatggccccaacttaaaactgcctattacttcaggccaaagggttccatggcgaaattgaggatttgcagcagtggctgactgacacggagcgtcatctgttggcatctaaaccgctgggaggtttaccggaaacagccaaggagcagcttaatgtccatatggtaagcaaagtatttcctacagctttagcctcagaataacaaactgaccatgttatatgggccctggcgatacataaatcgtgggagaaggctttaaagatatagtttatggcagaaatcactgtgtatacatgttagaaacacaccatttattgattaaaattttaaagtcagaacccattctttatttctttctttttttaattttattattattatactttaagttttagggtacatgtgcacaatgtgcaggttagttacatatgtatacatgtgccatgctggtgtcctgcacccattaactcgtcatttagcattaggtgtatctcctaatgctatctgtcccccctcccctgaccccacaacagtccccagagtgtgatgttccccttcctgtgtccatgtgttctcattgttcagttcccacctatgagtgagaatatgcagtgtttgggtttttgttcttgcgatagtttactgagaatgatgatttccaatttcatcc

SEQ ID NO: 15221 - DNA, 1146 bp, Homo sapiens
tgtatttaaccaagaagatgaaagcaaaagtaggatactgcctttctgttgtggtatctttgtaccttacaggtcctacctggtcctgcctagggtaatgacataaaatgtaaatccaaagctagattattctaaatctactaacaaatatattaatttgtattgtttttggatttatattttacttgtctatgttaaatgtatattggtttggaaaccaaaatgtctttctaagccttacagtattgttgatatttttaaaaatttgttttggtatttgttaaggtatttcttatttatcatttcttaaatatctttataataaacatttgacatttgttactaaaagggtgctgtttttcttttaaaatatttcttgttgaaaaaatttattgcagaaacttagaaaacagaaaaatgattagaatgccaccttctagaaataactaccattgatattgttgtgtactttttaaagttttgatgtggttttgcttaaaattctaaggctgtcattttcttattctagaccataagggaagaaatagatggactacaggaggagctggatatagttattaacctaggttctgaactcattgcggcatgtggggagcctgataaacccattgtcaagaagagtatagatgaggtacaactggcttacttatcagaatggcttttaaaaagtttttagttaactaaaatattttgttaacagtagttgaaagtttaaaatatggcactaaaagaattctaacatacatcttgtagttaaattcagcatgggattctctaaataaagcttggaaagaccggattgacaaacttgaggaggcaatgcaggctgccgttcagtaccaggatggactgcaggtaaggggattacagtgtatgtgctggtcttagctggaaggaggaatcgtactaattgatgtctacatattggcaccacctcaagatctgccagtgcatatgcaattgtgggcaaattattcctgcagttgcctgtgtatctcatttcatgttttgtcttttagaagatatttctgacctttcagatatgtgtagatttatatacacatctaaacacatttctgtatacacattcagtgaaatttactttgaaaagaaatattttgattt

SEQ ID NO: 15222 - DNA, 1115 bp, Homo sapiens
ctgaacggacaattttactcttgatttggggagcataaaagtgtacctaggtgattatttcactccctttgggattaaggatagccttaatgaacttgaaacttgataaacttggttctactctgagctcacttttgtcaggaagaaccttggtttggcaagaatagcagacccagagatattatgttatttggcatagactcttggacccactgatatccactggactggggtcattcaaaacttggtccagttttagatacttagcaaattggatcactactttctgtgtgaactataacattctgctttgttggttacgtggggctaaccagtcgccttgtggatattgttttgcttcatagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagaggtaagcagaaaatctcatttaaagttagaaaaataagttgtggcataatgaaatccagattccttgggtaaatgttaggagttactctgttaacatttatatttggttctgaaaatggaatgtgcagtgatacagtaggagatagagtatacccacaaatttcactttgagattgtatgtttaaaacaatttctcaggcctgcgtggtggctcatgcctgtattcccagaactttgggaggccgaggtgggcggatcacttgaggccaggagtttgagaccagcttggccaacatgacgaaaccctgtctctactaaaagtacaaaaattagttaagcgtggtggtacacacctgtagtaccagctagttcgagggtgaagcatgagaatcacttgaacctgggaggtggaggttacagtcagccaagatcgtgccactatactctaacctgggcgacagagtgagcccctgtctcagaagacaaacaaaaacacaaaacaacaacaacaaaaaatttctctt

SEQ ID NO: 15223 - DNA, 1185 bp, Homo sapiens
ttgaagtatgatcacatgtgggtgaaagggagttggtgaggtcaggctcactgagcctgtaatgattctactgtcatgatataaagccagtttgtcatcattttgagggtcacttaattctggcttggaatatcctcttcattttacttttctgttacctgattacttagaggttcccagaaagcaaagaataatacaagttaacttgcttgtttttgcttctgaaattttaaatatttatattaaatttcaaagataaaatcttgccgtgtcgacaaatgaattgttctttgaacttctcaggaaacatttttctttttgcaaaatagctttagataaaaaaggtttatttaactcgactgaaactaagggagggggggagtggggcaaagcatcacattattcgcctgcaaaggacttgagctccaagaacagttaaaggaaaagtctgttgaagctcttaagtgttactaacttatttgtatgttttcaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcaggtagggaaaaatggtttgttgtttaggcaataaattttctccagctgttcttggagcttttacctgaacaaagatgactgttaatactgtttccattcatttgctgtgcttccaaaatgaaagagtggatttgaaaagaagttgactgggcttcttcgacgtctgagcaccagggcaaggctaatctgcacattgttcacagccatctgcctcattgtttcacagatttatccttaccaagtcagacactgcgaagatcagcccagctttccaaacaaaatgcttttgtctacacatatgcatattgctgatattaatttttatgtattgactaagtctaatctgtatgtgagtaaatactgtgaattgttatgtaagtcagtattaactgttcatttacagaaagctggggcaaagagaatgttttctttttaaaaaggaagcagttttgttggtaatgtgaagtttttttctgaagatgacag

SEQ ID NO: 15224 - DNA, 2001 bp, Homo sapiens
tcaggaggctgaggcaggagaatggtgtgaacccaggaggaggagcttgcagtgagctgagatagcgcctcaacactccagtctgggtgacagagcgagactctgcctcaaaaaaaaaaaaaaaaaaaaaaaaaaaaagtcatagacgcgaaaaagtcatatttaataagagatggattatttatcaacataattaagaactttgccatcatcacttctccatactggaatagagaagacaccagcacagcaggcgatgtgtggcatggccactccctgcaccttgatgcatttttacttatttccttattctttgttttcccctctcatctgtatcctgcatcttttcttgattgtgtattttcttctgcctacttcttgcttcttttcccctttgtcaataacttaagttcacttgtagttcttatagtcaatgctaaaagcccttgcttttcaacaattctatatattcattcagagatttttattttggcttttcatagattaaattaacattttgatgtaaaataaacatatcttgtaattttatttctagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagaca

SEQ ID NO: 15225 - DNA, 1232 bp, Homo sapiens
ttgttcattttgtccatatttttcctttagggggatgggattagtttagacaggatatctctgtgaagcactgtggctcttcggatttaagagaattgtactgccctttaagtaaaaagtaggaaagtgataactaaaaaacaaaaactggagaaataattaccatttctgtctgtttggacaccaaatctgtgttttctacaatcaattatataataatttgcgtttgtttacccttgttaccttagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcaggtttgtctacttttaatacatatatttcctggtcagaaataaatgtcatatattgcctatttccaagatgttgccaataatccaggaccccaaagagactctgccccactgttaacatcagtgaagaggaggatgaatacaggagctcagagagcagttttgtgttcataggcacatggaatgttagggtcattctacacacataatctgttggcaaaattggcttcctgaaggcctattaaaatctcaggtaccccaaactggtttttaaaaaatgtaaatgttttttgctgtatgaaagtcttatttagccagaaaaaaacatgaatagttagtaaaaggctttgcatcatcttctcatctgctgttactttatctattctgtcatagaaaacttttctagagaaatgtgcgaaagagaggcatttgtcactattttcctctctcactgtggctataattctgtggcatatgtgatgatatttgtc

SEQ ID NO: 15226 - DNA, 1114 bp, Homo sapiens
acaatctccataaaaattatatttatataacattttttgcagttttgtgtatctgaaataagtaaaatcaagttgttcagtttgacacttggttttgttgctttctttttggttaatttgagatattttgtcacttgggataacgttatttgacctaatttattgagtttggtgcttgagatattgctaagtaacattttgtggtttgttttttgttacatttaaaatgtcttttttatttcacttgttatgcaattttcttgaattatttgtgactaaatagcattataagatgatccaaacttttatttctgaaaagcttatgactttatctactaggcttaataatgacaagctagaagtgacaaaataccatgtaaaacaaacttttatttctagacctctgctccaaatgtcctgaaaatgtgtcagtatagttgtttttcttactcctaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataaggtatattctgtgggtgcacctatggaagacatgaaagagaatggattagcagttggaacggagctctggtagtcagaagctctgctctgttttcttttctagctctgtaacctttagcacataattgacagttttgtttaatgtgcctttctataaagattgataataatagttacttttttttaaatttttggcacagccatgtcataggttagcaaactgttgggtgtaagccactttgccacctttaaatcagtttaagtctaggatgttaaccagtcaactactggaaaagatttatttaagggctaaatgtatgaaggatctgttctctgtagtataaaaatagggtagctaataccttccttttctttaatagagggtatttctttctacagctgccaaggttgggaaaa

SEQ ID NO: 15227 - DNA, 2139 bp, Homo sapiens
ttagcatgcgtgtgtatgaaggagggagatagggtgataatttttatatgtaaaagttaattcttcagaaatctttgtaactgtgtattgtcttgagaatggctgtgtgtgactcacctttttttcctccgaaagtaattttcaataagtatggctaatgtgaaatgtcagattgagaaccagtatttatttcaaagatttgctgttcggactactcttttgtctctctgtgacaattcaaatgtttatgcatccaaaaaaatctcttttcaaatgcagatgggatatatattaacttttaaaaaaagatttcaattttcagtatccattgggctcttttctttctttatattttaacattttaggtggtgttctgattatgcattaggaatttatcattgaactttttattttttaaattttttgtgtggaaattgtatgattcaccttcatgtgtttttgaaaagggatagggcaaagagaactttgtggttaatattcctgatctgtttggagtagatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattgtaagtgactttaaaaaaaagtcccattttcagttttttaaaaaaacagttttataagctcaaagtgtagttagatttaagataaacttaaggacacaaaaaagagacatttactgaatatgagtgtggaaagtaatgcttgcacaaaatcaagtgtgtaaaatggtttatctgtgaagaagtgtaggaaggactttgtgtactttttcttgaatattattcattatagagggcttatgcatacattgagtcttatcttgtttatcattgtttcagccagctgcacatgaggttaatcagatcagtcttgtctagtcttttaagaattaggaccatggctaatccccaggctccattagattctaggggttgctgagtagcagcagcctcctgcctctttcgaccaactagccagctgttcttcactctctcagagagatttaagatggcattcctcaagggacagaccaaacttgtcattcagtttcaactgttaaccttcctaggcacaggttgtgcaagcttatgttgttaggaatagtcatttaaaaaaattctgtcacattatttataagcatcataataaaagatatgcaatatttggtttattttagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggtatgcctcccttactactcaggaggctaatcagatagattaatagttagggcaaactcatatacttagtgccagaattataattggcaatcattttaattgcttatagattagtaaagatctatgttttactcctttaagaatttcaaaccttatcttttccttgaagcctttgctgattgattggaaataaatatcatttatcacatgtatcataggtagtataagtatcatcttacgtaccagaagccacaaagagacaaaatatagaatgcattttaaattaaataaggtttactgtgttccctttcaaatagcctatatgcatgtttattatatttagaatactggccataggcagactcattcttatgtgaaattatgaatagagccattctgatcccgcacagacctctggatggaatgccatttgaagatctagcaacatttatattgactgaatatcttaatgctttgta

SEQ ID NO: 15228 - DNA, 1176 bp, Homo sapiens
aggtccttattcaaatatgtggtgcactattgctatgtcaaaaagcttaacagctacttgatttattattaatatccagtggtagtaaataaggattatcactaaggattattatgggattctgggtttccaggtacataattgaccaagtactacaaaaggtttgaagagttggctttgcttaactttttcttaatatttaagtgaggttgtgaaactttcttcttgtgaaatgtgtgatcactcatcaattatagttaaaattttggaatgtatttttaagaacaggggaaacttcaaagtaactgcctgttgctctgaggtttaatttcagttgttaagttttcaattgtgtcagtttttagtaccctcattctaatttaaaatgttctaagtatttacttttggaatgtcttaaaactatgccttggcccacgttctgaattcctcctgtgaactttcccttcccaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggtgtgttgttataaacatatgatatcgttcaattctatttccaggttggtaaagagagaaataacctagcacatgagttcttttcaaaccttactgacaaaagaggtttttttctgtgttcatcatgtcagatataaattattatgagagttctaagcaagtcaaaaaataatgagaaataaattgtagagttggcattctccatgtaagtgaagtagaattattataaagatttaataataatagttaacatttataggacagttaaagtgggcactcttctaagttctttccattttaactcattttgtcttcccagttactccttggggtttttattttcatcttacagatgaggaaactgtaactgacagtattaaagtagctttctcaagttacatatctagaaagggctggaatttggatttaaaactaggc

SEQ ID NO: 15229 - DNA, 1279 bp, Homo sapiens
aggcttctggcctgagagtcagaaaactgaaattctggcatatttcattcatatttcaaatccctcaaagtattatttatatcttaccacaattacatggatgttgtaaatgttagcaagtcatattttaaggtagatgtttctcttcagtgtgctaaatatacctaagttaggtctttgccttttgtcagagttatattttaagtgcaatgtgacaggtaaagataaaacatttttagagggattatttgtctttttatataatactaactaccatggtatttaaataattaatttatcatttattactagatgataaatagatttttgatgaatagcaaaaaaattcataaaacttccattccctgatgtgagaaatgtatttacaaaacataaatattattgttaatataaattttatcatggcttaactttctactgatagcttgtactacttttttaacagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaaggtttgcctttcttcgtggagttggcattcattgtttttagtgtgaaaccataatgtagatacccaaggagtatagtgtgacaggaaagattttctggaaaggcattaatggataagatacagtgtacatacaaatcctacagtgtataacaatattgttttcactaatgatgctataatttagttgatttgaatttttgtgactcccaaaaatacttaacttcaagtgagagtcttgattgcctcccaccccaagactaggaaatttgaatgcacttagaaatttaacacattgaggaacatatgactaaagaaggttaagagtttcgttttcctctgggaaccaatacagcacagcaattcagatcatgggctctggagctagattgcctgatttcacatcccagctgcactactcattcattctgtgaactagggcaagttacttaacctcagtttaatcattggtagattggaaataacaatagcgcttacctgctagtgttgtgagcattgataaaaagaatgtatgtaaaacatttagtaccttgcctagcatgtgttaggctcttagtaaacg

SEQ ID NO: 15230 - DNA, 1907 bp, Homo sapiens
taagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaa

SEQ ID NO: 15231 - DNA, 1110 bp, Homo sapiens
gttgaaccattcattggactaccttatcgttatttcaaaactgaactgccatttgatgcaagccttactattcaagacactgtaattgataataattaaggttaagcttccacttttcttgctttttaagtttagcttcttgggcttgtccctagaataatcactgtcactaaattgcacaactcagggagcagaatgtttatattcaacccaataaggaatgcccttgggggtgtgcctcagggtgctgcagccttgagttctttatacatacccgtcttgtgcttagttcattgcagtccaattattttgtctctcccatctctacatcttccaccctcctgatggatatcgctggacaccgtgactattcggttactattctcttaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaaggtatgtaaaaataattccctctactgaggttatgtctgcatttggtcagtcatgctcctcatcttcctttcctatgttaaatgaaaaagtcaccaactctttagaggaaggtggagagtatataaaaaatattaaaatcttgcaacccaaacctacatacatgacttatttttatttcttggaagtaatttttgaaagcatgggtaatcagaaagtggagagtgttgggatacttttcaaattcctaatgataatttatttaatcataggtatagaaatctctttgacactttgctggcctcaatagttttctaggttcctaaataagtaaaaatggttagcaatggaaaattaaataccacatttgacagaaagttgaatgctttgagatttttgttctatcttaggggccaatcatctctagctctattttcttcagaaataggtggtggccaagggcatcaagtctgcttttggataattcctaaggagtttagtaatttctgctttgaaaaccacatggggtgggtcacttctgtggcttaatctgaaagttt

SEQ ID NO: 15232 - DNA, 1200 bp, Homo sapiens
tgtatttctttagcaagtggtgaaactattgcaaagcaatttttaaaagttatctcagtgatttttaatgcatgtatttctttttaacagtgggattagtaggcacttaaaagcagacaatgaaaaagacatattttattaatggaggtagcaaacttgcttatggaatatattttattttgttgatatgcaaattttattaggctgaacgttataaaattgtcattaaaaaatcagagtacaaatattgaaaatttcataaggtttgaactaatataatattgtgcatatgaaagatattctttcctttatcttattttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggtaaatgagtaaaatctacacatatgaggctatttttttacttccatagttaatttgttaattacaatacctctacttagccatatttctttcttacttggaggactttagtaagacatttaacttaaaataagcattttttcaactctgttactattcatgtattctagcatttatatagttaatctgcttgccttttctgaaggaaaaaacaatgtagttctctaattattaccaacttataatattcaaataaccatgacttagtaagagcatgaagcatgcatgtgatagggctgtgtgtagcttctatactggacttaagaaatgtaaataaatggaaatgccctgatgttcattttaattgaagatacaagaaagtcaaaattctcagttactgaattaaaaaaggttttagggttcatcttaaaataaatgaattcgtgtcctttctcattcactttcgtgcttatattaatgcaaataaaatgcttttatgatacagtgccattctccaaaagtaaaattatgttc

SEQ ID NO: 15233 - DNA, 1720 bp, Homo sapiens
cctagttaacttttgttaaatacagattttattctgaactttaaaaattttaattagagacaattttattagtaatattctattttttaaaaatcttaaacattaaatattatttacctaatatttacttttaaggatttttatttgatttttgtaattaatttttgcagctaatataattcacatttttgtgaacataaaatagcaacgtattactttggacagcatttaatcggaaattggtacttcaaatggcatttgggaaattttattaattcttcttaaattttaagatttatgttttaagatttatatccttagaatgggtttgtgatgaaaacaggaatcatttgcttgactagctgtgtcccagtaatataaaattctcatattaaaacataaacagaagcttctaagagatagaaaacaaggtattttctaaacatatttattttcacagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggaggtgagagctataaatatgttgggaaaaaaactaactctcttaatgaccttatgtatcaactcttgtgacttcttaatgttcagttttgcacactcacactagccagtctagtgtgaggtgaggtctgattgtgtaattattgctgattataaactaggattcagtctacctctgactcaggtaaacatgagaatatgtacacgctcaccttcattgtgatgaaggatataaggacttgtaataaaagtcattatacacctgctgtgtgcaaaagtactaagttagatgttgaggctaaggagatgaacagtaagggaattattgattgtaaaacttgaatgctatgatgtagtttctttgataacaaacaaagaatatgtagatttctaagtcattggttcttaatgtgaaatgtgtgtttttcaactagtttaagaaaaacacctcatcacaggtgatggcctgatacctttgtttgttctctgttttatagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagtatgtaactgctatctcaatatataaattgcttcatacaactctcatttttatttactattaatttaaaattttatttttattaatataaatattaacttttattttgtcttaagaaatacattattggctgggcgtggtggctcatgccggtaatcccagcactttgggaggccaaggcaggtgaatcacctgaggtcaggagttcggtaccagcttggccaacatggtggaaccccatctctataaaaaataccaaagttagccaggcatggtggtaagcgtctgtagtcccagctactcgggaagctgaggcaggagaatcacttgaacccgggaggtggaggttgcagtgagccgatatcgcgccactgcactccagcctgggtgacagaggaagactccatttcaaaaaaaaaaaaaaagaaat

SEQ ID NO: 15234 - DNA, 1154 bp, Homo sapiens
acttggaaaacacctccttaagttgtattaacaaatctgattaggaaagaagaacgtagaattttcaatactgtagagttttggtttagtaaaaagagaataaatgcttttaaattggacacaaatgagttaaatctgactttttcaatctgttgttaacctctttgaaactcagatttcctatatgtaaaatggataaaatttatttatttcctatatgtaaaatggggaaaatttataagggagaggtatgagggctaaataaaaataattatatagaatagctaatggtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagactctggcttaagaaaataaaaaaaaaaatttaaaaatcacatttccactacttagaggccatgattctgaattgtagcttatacacacacacacacacacacacacacaca

SEQ ID NO: 15235 - DNA, 1179 bp, Homo sapiens
aaaccataaccgcctttttatcatgccaaataaggatatttccctgtttgacttaactgcaccaatttcgaatttataataatttaggtagaatatgaattgtagttttattctttcacaactcctgaagaagtagtactgaaataaatttgtaatgaaaaaacaactttagataaggcagctacctaagataatacaatgtttttgagcattttttgtgtgtattttaaaagcattaattttcttatcaataattaatatgttaatatattgatatttatgttacctctattttttcaagtaggctgtctaaggaactctcccaggagaacctgacagctaattttttatgaacgtacttgtttgatgtaaaaaaattgcattgaaaaatattttaatttataattttcactaaagcaaactatccttcttctcgtcacccagttagtataagccagtgaggcgatctcatttgggacaagccttcttttattatttatgtttctttctaaagatagctgattgttttccagaatactgtatcctttagatatagaacttctttaagagcggactgtgaaccctttatgtggctgatgttttgctccctactgcagagctcactaggatgcctgcattttacccaaggttcattaatggaatgactcttccagtttcctttttttcctgagggacctttcctctattattgtgtacagattgggctcttgattttacctgtgattgatttgtttttgcttaagataatagtttacagggaagcttttatattggtcagagatattatggcctcattctgtttaaaattcgtagttttctttgtgtaggaaaagttcaagcttcttaacctgggatataaagcctctatgtccaccggcgcatcgttccagcctcatcttccacctcatgcttcattgacttcaccactgctttccttccttgcaactcatatgtagttttgtgtgtccttgcctttttcctttgttcttgctcctccctccacctgcaacattcccatcttctttgctgggaagacctcagactgggttaagctcctcatagcttcctgagtgttctctgaatgcatttattttatactgcaatttcttgcctaaatttctttcatttcagattacaggcttcaagaggtggcactct

SEQ ID NO: 15236 - DNA, 1233 bp, Homo sapiens
caaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtc

SEQ ID NO: 15237 - DNA, 1132 bp, Homo sapiens
cagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaact

SEQ ID NO: 15238 - DNA, 1198 bp, Homo sapiens
aacacttccagtacgggaaaaaaaaaaaaaaacctatttagagatttttaagtgactcattcaacacacttgcccagaaggcactaatatagaatttgtagattttaaaaatacagtatgggcaggcaacgcgctgagggactaggcagagccgtggaaccgccgccaggtcgctgtcggtccacgccgcccgtcgcgctgcccgcccgctcggcgtcggccgccgccatgggagtgcacgtggaaaccatctccccaggagactggcgcaccttcccgaagcgcagccagacctgcgtgatgcactacaccgggatgcttgaagatggaaagaaatttgattcctcccgggacagaaacaagccctttaagtttatgctaggcaagcaggaggtgatccgaggctgggaagaaggggttgtccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacgtgtgcacataaatccatatggagcttttcctgatgttccactccactttgtatagacatctgccccaactgaatgtgttctgtcactcagctttgcttccgacacctctgtttcctcttcccctttctcctggtatgtgcgtttacctaaactatatgccataaacgtcaagttattcattttactttttcattttggggtgaagattcagtttcagtcttttgaatataggtttccaattaagtacatggtcaagtgttaacagcacaagtgataagttaacgttaggataggaattggtgttgagggggttgcaagaatattttattttaattttttggatgaaatttttatctattatatattaaacattcttgctgctgcgctgcaaaaccatagcagatttgaggcactgttgaggactgaattattctccaagttgagagatgtccttgggttaaattaaaagccctacctaaaactgaggtggggatggggagaggctttgcctccaccattcccaccccaccctccccttaaaccctctgcctttgaaagcaggtcatgttcactg

SEQ ID NO: 15239 - DNA, 1140 bp, Homo sapiens
tttcgtggacttacgtgtaaatggatttgtgagtcgactgttgtaaccaatactcaaacgaagatataaagaaaattaactttttatgattttttccatttacactgatgtgcctgttcatattcctttctgcatcaggtcacagcctaattaatcaaaagataaattgccacaagagaggtgatggttgtctataagacactaaatattactgtagggggcttttgccttgtttcatttttttttttttttcctcccagaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaat

SEQ ID NO: 15240 - DNA, 1228 bp, Homo sapiens
tgtaaataaaacaagcctactttatggttttaataggtatgggataaaaatttaaaatatttgattttagctcttttatgtggacttattgtaaaagcagtgtctgatgcttaatttgtgaaaaggttgtggttaaaaacaatagtttttatgctttaagccatgtaattcttttgtatgtgtcaagttaatggactatatacatagtttttttttcctaaaaataatgaactgagtaaacatttagtaggatttctggtaaaatgatatactacatgcatgatgaagaaacattatttagtaaagattcgttctacatttccaaatgtatattctaaaaacaagtgaggattttttttttaaacaacaattcagaaataccttaagtgtgttcttagactcaaaactattaaaataatttggtattaggtgattttcaattgatagctttatttcttatggtattttttttgtctttctatagggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacaggtaattcttacttttttttttttttttttttttagtctgcaatttaaaataaaaaaattttcagcagctttttcttttttctttttttcttttttttttttttaatgaggagggtagtaaatttagggttatttcctttgaatttagagcttcttttccaggcatcagaattaaaatttaaactaaattttcttccaaggagtgtggagttatcctcaaggatattatggatataggtagggtgaccatataatttattatccagtatgggacacttactagaattacagagagtactttaataattacatcatgacaacaggtgtaaattgggactctttagtaaatagggattgcccggcaaattgagacatgtggtcaccttaggcctgctggagtcgggggatggctgaattgacctttctcagcatacctcccagcccctgaaatatttacattgtttgctcccatttca

SEQ ID NO: 15241 - DNA, 1149 bp, Homo sapiens
ttaatggtaaaggaagctcattttacttacgtcactcctaggttactttttatggaaaagagatttgatgaaaacatttcttttaataaggtataatattagtctgaattttttagaggcttttccccctgctagaattcagagaactttgataaatataaaatttgacatatgttaaattatatatatgtgtatatatatcatgtcaccattatgagtactgttcaatacatttttgttgagcaaattatagctcagaataaagaagtgatatattctaaattgtattgaaataaaagcacatgacaaaatagctaagtatttttatttattttttccccctgtgatagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattg

SEQ ID NO: 15242 - DNA, 1238 bp, Homo sapiens
aggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccatgtgaagacattagaagaaatgcttcttgaaagagccagtcagaaacatggggaatcgcaaactaaactcaagacagaaggaccttcaaaaactgatgattctacttcaggagcaagaagctcctccactatccgtatcaaaaccttctctgaggtcctggctgaagaagaacataggcagcaggaagcagagagacaaaaaagcaaaaaggatacaacttgcatcaagctaaagactgatagtgaaattaaaaaaacagtagttttgccacccattgttgccagcaaaggacaatcagaggagcctgcaggtaaaacaaagtccatgcaggaggtgcacatgaagacggtggaagaaattaaactggagaaggcactgagggtgc

SEQ ID NO: 15243 - DNA, 1167 bp, Homo sapiens
tacctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgttgtatgatagcccttctccaaagcaggggtagaatgttcaggtttcaccacggattttctacttatttcgcttttggaatcagcttacagattccag

SEQ ID NO: 15244 - DNA, 1176 bp, Homo sapiens
tttagtcaggcttttcaaagaaatccgcattttaaaagccagcatttatggtccaaaatatgggacgggaatcagagctggtagaaaaatatgaaaagcctctttacaccctgagtatttgaaacaatccgatgagcataggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagggatgtaaaactgtgcttaccgatgcatcccatacgaaatgcttatgtgatcgtctctctaccttcgccattttggctcagcaacctagagaaatagtaagtaacaaagggaaaacacggctttaacgcaaagacagggatattgtggctagtgtttctccagggaactgcattttaaatggggaaatggaaaatgttgcagggtacaaaattgggttcgtctcctccttagctatagtagcttggtggaatgaattctagttggtattctataactaaattctactcaattttatgtcttctaacttgaaatttctgcagtgtagtttcaaggatgaagtccaatcatgtcactaatatgctgcaaactttcaaataaaaataattgtcaacttaacctttattttaaagctggaaagatattctggggaattttagagggtattgttagtagtagaatgaagaccccagacactatagtgaaacacattgcatatctgcattggatattttcagtacaggttttctggaagtgtccttggatgtaaatataaataaataaatatatatgttaatcaaatgaagtttttgtgaaagcatggctgtcaggaactgtaaaattattccttaatagtatatagtttttcaaaaatagtttctgaaagag

SEQ ID NO: 15245 - DNA, 1196 bp, Homo sapiens
ttaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgccttaggttctccagagtgatgtggaattttaaagtgtctctctctgattgcctccaaataatatttacaatatagctgatgaatgttactcccatatgcaaattgttttcagttttctgcataaaatctttagcaccactcaagtagatttcatgaaaagatttcaaactctagttagtgctctaagagcatggcgttccaagatgtgttatattgttcaaatatcagtccattagataacttacaacctctacagtatttaaggcatacatattgttataggtagcttttgttttgcatctgacctcaaaatgtgtatttcaatataaataggggtattgtcaagaataattaatcctggaaaaaaaaatcagtttatggattaatttaagatatatggcatcatattttggttttagagataatttttcattctaaagatttgaaatttgcaaaagatgtaatgaaagctgtatgacatcagtagggtattttgaacacattctggatagtgagaaataataaaaaattatattctagtttactaacataagcacattagaactcataaaaaagtatatatcatgatccttgaggtaaaatatcattaagtttctgaaaaaaagtttaggaattaacaactatatctaagttaattattctctcccttaatttttgtgccatttttctctgttctgattcttcatctctcttgataaaccttcacagctttcgtatttggcttctgcttctgcaactaccctttagcattattcaccaggatttcattcccttctgttcttattttacattttcttttttctttttttttaagatggagtttcactcttgtcgcccaggctggagtgcaatggcacgatctcagctcactgcaacctccccttc

SEQ ID NO: 15246 - DNA, 1654 bp, Homo sapiens
tatcatacaaagtttataggataattttagactattttacttcctaaaattttcttactccttagtagttaaagcacaatatcctagtgtaggtgaaagttagttagagtagcggactcattaaaatcccaagattgctttggtatttttttttaagtaagttgtggttaatctttggggaaactgtatctagaaagtagataaagaagggaacaaagtagctatttgctttaagaaatatttgtatggtactctgtttttattccagtgcttggactagttgtcacattaatgaaaaaatgaccaactgtgtggctaaagaaacaagaattaaaagtgaagtaagcctcttgaactaagccttttatatgtttcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttg

SEQ ID NO: 15247 - DNA, 1147 bp, Homo sapiens
aggactgggaaatagtcatgagaagccacggacagaaattaaagatttataagaatgcctcaataaagtagatacttattaattaaaacaatttttaggtgactactgttagctgagggtgttaagtgggtgtgtgcatgcatgtaagcatgtgcatatagtgcgatgtgctaagtatgcatacttgttttctctatatatgtacatgcaacaaacagttgtttaaattgaaaacattcttacaattaaatttggtttcgcataatcatttatgaaggaaattgaaaatatttcatataaaatcaagaaatagagtatattttgttactaacatttacgttccccattctgtgtaatttgaatcatgttcatctttagattaacagttgctagtactgtatattctgcatttttgtttaatttattaatcatgtgttatttctaaattttatttaattgaagtcatttcaaaagcattgaaatcttaaaccattcagttcctgaaaggttcttcacatgttttaataggcttccattatgtgtttttgcagcaagcttagtagtggaggagcgaacaagacagatgaaaatgaaagtgcatcgatttaagcagacaacagggtctggttctagtcaagaacttgatcgcgagcaatattccaaggtaaaattagtagtatccaacaaatagtttcccttttaaaaatgtgtagtgtgtgtaccaggcaggattagaaagcaccgaattatataagagaagttatcatttgggccgggcatggtagctcacacctgtaatcccagcagtttgggaggccaaggcaggcacatcacctaaggtcagaagttcaagaccagccaacatggttaaaccccatctctactaaaaaatacaaaaattagccgggcgtgcgcctgtaatcccagctacttgggaggctgaggtaggagaatcccttgaacctgggaggcggaagttgcagtgagccgagatcgcaccactgcacaccagcctgggtgacagagcaagactccatctaaaaaaacaaaaaaagaaaaggtatcattaaatgatagtcctgcatcataatttctaccaaagccaaaaaaacaaaaaactctttcctcttgatattttcgtgtgata

SEQ ID NO: 15248 - DNA, 1181 bp, Homo sapiens
ctacctggcggacaagcatggttttaggcaggagtatttagatacattctacacatatgcaaaattccagtatgaatgtgggaattactcaggagcagcagaatatctttattttttcagagtgttggttccagcaacagacagaaatgctgtaagttcactctggggaaagctggcctctgaaatcttaaagcagaattgggatgcagacatggaagaccttacatggttaaaagagaccatagataataattctgtgagttctccactccagtctcttcagcagagagcatggctcgttcactggtctctgttttcttcaatcaccccaaaggttgtgataatattgttgatctcttcctttaccagccacagcatcttaatgtgtccacacattcttcactatttgactacagcagtcatagcaaacaaggatgttcgaaaacgttggcaggtgctaaaagatctaggtaaagttactcaacaggagtcttacacatataaagacccaattacagaatttgttgaatgcttatagattaactttgacttagatggggctaagaaaaagctgagagaatgtgaatcagtgcttgtgaacgacttcttggtggcttgtcttaaggatttcattgacaatgcccatctcttcatatttgagactttctgtcacatccaccagtgtatcagcattaacatgttggcagacaaattgaacatgactccagatgaaactgaaaggtggattgtaaatgtgattagaaatgcaagactggatgccaagattgattctaaattaggtcatgtggttatggtaacaatgtactctcaccctatcagcaagtgattgaaaagaccaaaagcctttcttttagaagctagattttggccatgaatattgagaagaaacttaatgacaatagcaggtcagaggctcctaactgggcaactcaagattctggcttctactgaagaaacataaggaaaagattttaaaaaaactctaaaagaaagatgaaataataaaactattatataaagggtgacttacattttggaaacaacatattgagtgtaaattgtgaagaattggaataaaattgactgattcaaaaaaatttaattcacaaaaaaattttaatccttttaagctaattatagattcacatgtagttgtaaga

SEQ ID NO: 15249 - DNA, 2041 bp, Homo sapiens
gtttccgaatttcggttttctcttttgttcaatggcaagagttcctccagagttcccgggacgttgtccgggtcgccagcaaagtggagccgcgggtcctgctccttaaggccgaggggatacggacccttctttggaacgtgtgaggcaggaactcgattcggcagctactgggtggtcctcgcaccctcaagcctggacgcccgctttccgaggttcaggtcccaccggttgttccctagaggaagaggcaagagcaccttgcccccagccattcccaagcccatgggattctggtgcgaaagacacaggtcaatgcaggtggaaaccctagttaacttggagacagctgggcccgggtgaggctctcccgaagtcgcgggaagcggaagagttggcaacctgctggaccgcagccagggcggcggggcatggactcagggtcctggcccgggccgggggcggggcctggccgggggcggggccaccaggtgcgaggctttatcgcccctgagcctcggccggcgtgattaggcctggtttgcgctggagagtggtcttggttgtgagggtcataagatgggaactctcccggcacgtagacatatcccgccgtgggtgaaagttcccgaagacctgaaagatccagaggtgttccaggtccagacgcggctgctgaaagccattttcggtgagtgtgcccagtactggcgggctgccccggctcgggagtctcagccggcccggggatctcatctcttttccccaacaggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgaggtgagaggcccagagactgggtacgcggaacacaggctcgcgggggccgcttcgcgcctctcctccagccctctcctctttctcctctcttgctcgctgccagcaccttgggcgtcaccaggggtgcccttggcatctgggccttcccaagacccctttgggaatgggggccccagaatgccggccgtcggtcttggagacccaggggtgagactatggtgaaaggcggctggtgctggacccactgggcagggttatctgagctatctcaaccgtctccccgcccccttcagtttcttggagaatgttcgaatgggccgagtagtctcgggttccaaggttctgggcctgactctcaggcccagaacgcctggatcagaagtcccagaaacgaaccctgaaagaggcggagaacagtccgggcgcttactattttcccccagactcacgccgctgttgctatttctggtgcagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttgatagttcagtgtggttgatggattgtaggtactaccttaaatatctctgaagcacagctgaagtgtggccctgagcttaacccttaattgaaatcctccaaagacaaaatgagggtccaaaggcacacttggctagtgtcaaaaagggtggaggagccagggtcctgagatgcagcactgaactaaaaacctatgggagatgtgatgattgtctcaagtgacctggactcacttgaaaacaaccctataataggttgacattttgtatataagctgaaaagcaaatgtgtccaacaaaaa

SEQ ID NO: 15250 - DNA, 1375 bp, Homo sapiens
tcgagaccagcctggacaacatggtgaaactccacctctagtaaaaatacaaaattagctgggtgtggtggtgcatgcctgtaatcccagctacttgggaggcctaggcaggagaatcacttgaacccaggaggcggaggttgcagtgagccaagattcgccattgcactccagcctgagcaaaagagcaaaactccgtctctaaataaataaataaataaaaaataattgcatacttaaaatcttctggccctggccagttgcagtggctcatgcctgtagtccaacattttgggaggccaaggcaggaggactgcttgagcccaggagttcgagaccagcctgggcaacatagggagacctctgtctctacagtgggtgtgatggcatgcacctgcctcagctacccagtgagctgagatcgtgccactgcactctagcctgggtgacagagtgagaccctgtctcaaaaaagaaaacaaaagaagagaaggagccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtgaggcctttcgtttttaaaaaaaaaaaaaaaaaaaaggaaagaaaaagagaaggtgagaaagaatcttccggcccttaagagctctgtgaaacgtcagtttgctctggccgctttcccattttgatctcgggctggcgtcaggcccactgcaggatccctggcaccccaagaagctaacccagatggcgggaaaagtgttctattaacccagccaagttggctcagtgcatctctccacctcagtctctggtgttggcttccatgcactcgggaaaactgcccacttgtccccaggcttccaaggaggcccacgtgactgactgagctcccaaaaggttttcttgcacaatagccctcctgttttggcaggctcaggtgcaaaggcctatcggtctccccaaagctgagagatgcgaaaccaacacttgcgaatcagattctggcctctcactgagcagggaggttctttcctcaggggagagcagtaatcccacaggatcatttcttc

SEQ ID NO: 15251 - DNA, 1949 bp, Homo sapiens
gtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttattgcagaggctaaagtcatttgagactttggatttgcactgaatgcaaatcttttttccaaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaaggatgactacttaaatgtaaaaaagttgtgttaaagatgaaaaatacaactgaacagtactttgggtaataattaactttttttttaataggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgtttt

SEQ ID NO: 15252 - DNA, 1176 bp, Homo sapiens
tgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgaggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatccgacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaacgactcttaatccttacagatgggaaagggctccttcaagtatgcctgggtcttggataaactgaaagctgagcgtgaacgtggtatcaccattgatatctccttgtggaaatttgagaccagcaagtactatgtgacta

SEQ ID NO: 15253 - DNA, 2253 bp, Homo sapiens
tggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaa

SEQ ID NO: 15254 - DNA, 1222 bp, Homo sapiens
taatctgaaggctggctgcaaaagcaagcctgaaactctgagaaacagaccagagggtataaaacacacctcaatgaaactgtctgtcccctccctacttagattggtccccagttgcacccaaccttagcaatttgaaacttttcatgaacaccagacaagatgtgaatgctggctgctctcatccttaggccaccaccccaaaattttttaaatgtcaaagacttcagcgcgcactctcaaaggacgcccaccaactctggctcgtagctcaatccacccgcgccccctgggccgaaccggctcgcagccgagcccctcgcctaggcggactcgaaccaggtgcgctcgcagcacactccctccccgtcatcgctcatccctcgtacttcaccgcccccgaaacccacccagcgcagataactgaatatccggggttctgggggccacgttttccagtataccctcccttctccccgtcaagggcagaaacagacgtaccttccagaaaagtaatctcccctgcgctaccgccgctcttgccggccgccatcttcctcctcccacgccgcctccttcttaatccatggcccacaccgccgccgtgctcgccgggatgaggggccgcgccggaggagggtagacgccgcagggttgcgggcctcgggctcagccgtcaggcgggctgcgctcccacgttcagacgggcctatacaaaggcaggccaggcgcgcccgggcctgtccgcgggctggcgggcagcgaggcccgcggcccgagcttctcaggcctctccgggggaacgcgaccggcgacgacgacgacggcgcttcccgggcccggttcctctcggcccacgactccccatccaccgcccacccaggctgcctgagaaacttcccccagccgtgggttcccaagaaaggagaatgaaagcgagcacacaaacacgcctcccttcgtcccaggccgtaaaatggccgcacccgccgcgccggagcggcgaggtctctgcgaccgtcaggcgcccccaggcccctagctcgttctgcagccgccgccgctacggccgtccgcccaccccgcccaggcgtgaatgcatcagcggaggcctttgcgactgtccatgtggacaggggtgggtctcctctgccaccgcctcgcgtcggtcgccacagcagctccagccgccgccgctgccgctcctcccccacgggcgctg

SEQ ID NO: 15255 - DNA, 1430 bp, Homo sapiens
taggggcagcaaagaaaactgtataatcaagtcagcaggacagattctacttacatttgtcttttatttattctgtataagaataagcatttcttattccaactgcagcatgactgtcactaaaaagattttgatgttcaaagacaagtcattgagagttcttcggttttcttccttcaaaaacattgaatgattttatgctacataccaggcatagatgaggtgcataaagatgaatatgataaaatctctaccagtaaagctcaagtttgattgcagtagagattgattagggtacagaaagacaagtaaacaaatgattacatgcatggttagggcagcagtagagctatacaaaatacgtgtagtaaaaactacagagaagggaacaagaatttataaaggaaacattaaaggagtttttgagtttaccaggtagaagaagaaactgcatgcagtaggaatcacgtcttcaaaggcacaaagaaaggctttaactaagattgttgcttccagggatttagcacaattgttagacttcaggtgagggtaaacacattggcttttacagcttctcctaaattttcttattttctgaagtcttaattttttttttttttttaattatagagatagggttttgctctgttgcccaggctgtagtgtagtgtctcagtcatagctcactgcagcctcaaacttctggtctcaagcaatccttccacttcagcctcctgagtaactaggactgcaggcatgcaccaccgcaccaggctaactttaaaaaaattttttttgtagagacgtggtctcactttgttacttaggctggtctccagcttcaagcagtcctgcctcagcaccgtaaagtgctggaattacaggcctgagcactgcacctgtctcaagtcttataataatttgaaatgaaaacaaaagccatccatctggtaattcatacatagtgtattcttggggtgagtggtatatcttgtcttttaagtaaatcagtcctgctaaaatctgagtaattcgtagttctttagtaataatatgggaacgagtgctttacacctttttatctaaacagaatggtgaagtttgttaaaataccacattagattaggtagtctttgggtcataattaagattccaatctattttcttaactgctattccaaatgttaaattcatatttaaaagatagattgtttatacactaatagtgatagagaagtatggaaaaaaatgcagaaatttaaaagtctgtagttcataccatccctgcccctaacttcaatctgacttgttgaaacaacacattttatgggttgatgttttacttacactttcacattttttgactttttattaagtatagataaaaagacttataagaaccttataagaaattcttgtaattcttataa

SEQ ID NO: 15256 - DNA, 1117 bp, Homo sapiens
ctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggacc

SEQ ID NO: 15257 - DNA, 1130 bp, Homo sapiens
ttacgatatttaggtatgtaattccatgattaaattgcttcctgctttaaaatataatgtcttgtttcttgtcctaaaccttgaccaagacagacacggagatcctgtggattttttttttttttttttttttttttgagacagagtctctctctgttgcccaggctggagtgcagtggcgcaatctcggctcactgcaagctccacctcccgggttcacgccattctcctgcctcaacctcccgagtagctgggactatatttttttctttatactatagagaataatactgaggcaggagatcttctattgtgcttcttagccacagatttgacaatagaatcaatgtcaacctaagcagtgttgatttgttcttctcacataaatccttaggtattagtacaaagatagataatcattcaaggtgtacaaaccaacattgatttcaatttgagaaacctccttgtcaagataagtcctgctacaccactttctgtaacataattttcctctagctttctcctagtcggatgtttaatttaggtaaaagccactgcctgagagaaacaaaggacagtaccagtctatatccctatggttaaccagatatagcactaggaaaatttttcattaaaatttctcagtgataaactgattaatgtttttaatatcagcagatccaattaagccatagttattcatgttcatgtgtgatgtgattgctaatttggtcaatttaattataactccaatgagttatccattcattaataagaagcatgttttaccttgagcaatacttggacacatcaacagacccttgacctaagtcatgtgttgctcctgggaagaactgatgggtgacaggtgaccatttttcaaaatctatacctgccatttggttttgcctcaataatgtcagaatcttcatttttagacaagttttgtagaaaataaccccagaggatttgaacagtcatgtcctagggcatagcacttgctgtcagctattctccctgcatagaagatacattgtgctacttctattttttaatgttaaatttaagagaaatagaataggaattgcgttttactactgtatctaaaattttccagtttaatgtattac

SEQ ID NO: 15258 - DNA, 1117 bp, Homo sapiens
tttttttttggaatagcttaatgctataacaaattgcaatcatctttatatttaggattacatttattttttgacaggttttatttgtcttttaagtgtcctatttatctgtttttgataagtttctactagaaatccaaacgtaccatgaggattctggatttaatatggatcctagaaatcctgaaatttattttttaggataactttaatgtgcagtgaataaatccaggtagatagttctagactttagattaggctggaaaaatgtatagtgtaatatcaatcccattatcaaattgaaaaggaaattagataaatggggtaaatgggatgagcctgagattctgcatttctgatacacttccaggtcatattgatgctgctggtccgagaaccactatttgactagcaagggactgtgagtgtgagggcgggggttggtagttgaagagagtgcaaatggaaggacagcatgctggtactttgagaaggaaccagcagagagagaaaagtagaagatacagaaggaagaggataacaaaagaatcattgctggctcaggttctttaatgtagaagaaatacagagcgcaagtggaaagacttgtcctagatctcaagaatatgtcagcttctctttttctgagactcttttgaaggtaggagaaggtgcccctttatctttgtttttgctgagttcatttctgacaggttttctacaagctattctttaaagtttattttcttctcccacttctcccccagtgccctttattcagaaatctgtgtcctggccccattgtttcttttttcaactgcctttgggttttcattcttgaatttctttccttgctgcttcaactcttgtctaagaagtcgtcctcccctcttgccttgattatagataaggaaatgaggaaaataagttatctaaaaggttaaatatatagtaaatggaatggggttcctatagaattctagaacaatgacttttagtactttaaggtggttccttagatcagtgaattccccacaagctgcatgagcatcaggtgggaagttgttagaaatgcaaattctcagatcccaccattcctgattctgttaagaatcag

SEQ ID NO: 15259 - DNA, 1817 bp, Homo sapiens
ggtaagcaataaaaacatctccaatttactgaaagttcagaaatataactcttacatgcatggaaagtgtaaaccaatttaggtatttctaagtacccaaccctagtattctctccctcaactccaacattctcaagtcccagatgaaaagtttcagtggagcattagtttaaatatttagtctaatcagagactcacagccctgggcaatagatacatagctttttaaaattttatcctttgtgacctgctatagtggcattggactattttctgcatgtattataaactaaagattggccttatttcaattgtttttattgcacaacttcactacaaatttaaagactgctggcattattataaaactgtcttcctccaatccaagtaaataagtatgtggaatatttgtgagctggattaggtaacatctgagacttgggattgactaaatttagttatcacttggaaatgaattacataagatacagtaatcagagaaaatatctttatgcagcatgtatgttaacatctagaactgtccctcatctgcagtgcagtagaggaatcagacattttaagaaatgtattcaaatatttttatcttatatgttagcagcatttacatgttttcagatatgatttgtaatataaattaatttctccagttaacaatgtttacttcaattctgacattccattttatacatatatacctactgtatatctctctcaaatgtcagctagaagcaactttttcagttttctatctaatgaaaacggatatattctgaatgtttttgttacctgaaatttatttttgagtaggttgaaaggaccaagatacttgagtgattaaaggactgtaagtgttctgcttatatgcaggagttacatgattttaaaagtcataataggggaagtagttttatcatctgattactcctattaacctaaaaagtatttctaacataacagattgagcagtggttttgttacacttaggcaagaatttattttcccattaaaatttgaaaaatacacttttctttgcttctacccttgcagtttcccttagttcccctaatttccaagtgatctgaactaaaattaatattacatttactaagaaactatttttgttaattatactgagcaaagtttgctccaaatgaaaagtcattacgaactatgtatagtacccaagaaaaggtcaaattgagtcagaagactgtaagtaccacttttggcgctccagagataaaccttgtacacactgcagtagaacagtgagtagaaaatatgagctataaatagatattatttttagttttgatagctctgtgttgaaatacttttttaatgcagataaaaattatcaggaaattaaccttatggcacagaccaaatacttagtgcatggctgagtttctacaattcaaggagccaagaaaataggttcaagatggaatatagtacatgcatataaggcagatgcacacatgctggttactttaagattgtgtgtgttgattagtcacaatgatagactataacatgagacaatacaaagttacatttttggaccatattaaaactgcaagaagacaggggtcttactgaagatcttttagaaaacttaaatcctgtcacaggatatttagacatgtgtagaatgtagctcaatttttaaaaagtaactgacctagagggtgaaagttgaaactgacacattttcaaattaagattatgcttattttgtacagaaaacaatgtttaaacacaagcagatctgttgtatgtaataagtaacacag

SEQ ID NO: 15260 - DNA, 1112 bp, Homo sapiens
attacccaggtataaattcttttttcaggattttttagatagcagtagaataaaaataattttaaaatgtcatactttatagtttaattttaagggggaaattggttattttcaattattaaaggttaaaataggccaaatcactttttatgcaatcatgttttatacagtggtctcattgcacattgtgttttttctgcactttttacggtatccttatcatgctggtatgtcaatatacaccctaaagaaaaactccatttaatgattgtgccttgtattctattattttttgcatcattagtaaaattaagttgtctattgtaaatgataactatatgacttaggagaatgtattgctatatgtactgctatggaaaaggaaagcagttatttatttgtttatggtacagttagttattttataccttaaaaaccaacatacttaccatttctattgtttaaaaattactgtccatttttttaaaaatttaaagaatgtagtattttctgaggactggtatggtacaaaaatgtaatcaaaattttcagatactacatttttaaaaagtgaggatggggaaaatatgtatcagcatgaccctgatgtagaaaaataaagtctgcaattgaaccttggcaaaatacattacataattatttctgataaggataaatattagctgtcatttaactgtcgtgaagaatgaaaaagtgatacatttgggctttttagatcatttgtaactaaatttgtacagaaattctcctgtgaaattaagtaaaccattttccagatcttgactgcattgctgagattttgcagttgaaaaataatttcaaatttttcaggttttttgtatatttatttttttctaacaaatatatttaactataaaattaaaattcagtagttaaactcttcataatgcagaaatggatggcttgattgtatagaaaaatgagtctttcagttacaccattcttgaaaataatagtgtatgtttgaaatttgtcattaattagttgcttttgaaggcaatctatttgaaatatgtaatttcctgatgttatctgcattgtgttaagaaaaaaataataggctataaaat

SEQ ID NO: 15261 - DNA, 1099 bp, Homo sapiens
ttgaccaagagtaacttatttctaagttaggaataagaaacctttagtcatcccagctttatactcaatcacaatgttaacttagataagtcacttattttctatgagctttacctccctcatgagatcgttaagaatctgtctcttttaattagaaaataaataagatcattgaactattagtgttttctaggttcttttttctcattttaataaaataatttggattatgtcattacatataagtataccaatggggccttactgacaagtttgagagtcaaacaaaaaaagaaactccatatattaagtgtactgttgttcccttttaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaa

SEQ ID NO: 15262 - DNA, 1228 bp, Homo sapiens
cagatgagattaatttttttctgataactggctttagataatgtcatgtttttagctgaagatcagtgataggaaactcacagcttcctgagagaaaaagccccaaacaagcttacttttagttttgtattacaaaacaaaatagataatattagtcaccattgtagcttgcatttgttttgcagctatgatttttttttttttatttcagaagttcaatttcttttacagaaatccacattgagggtactttgatagtagatagggaaccaaaggtaaatattaattatcttatcccacttgtcttatttgctggtgagtacacaagtgctctttttaagtggtttaataaagagctttgtgtaagctaacacaagtatttaacactttttggtatttaaaaatatacttgttcagaagtggacagaacaggtagatttatcagtgttaagattttgaattaaaatttatggggttaattctattaatatccattcttactttaagggttctgatgactgtcttgtgaaaatatgggcaacagatgatgggaggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacaggtaattgtcttaatccctatacattgttgttgttgttgttgttataatgtaaagtaaatttaatgaagtcacttttggttattaaattttaagaagttacttttataatcacctttataatccagtatataaggccaactaaaatgaagacaggagtatgtctgctttctttataaatatatggactttaaataacataaccttggtaaattcttgccattttctaactgttgttgttagttgctatttgtatggcaaaaagtagattttattttgactgtgtcactcttgtaaagattttttttctgtgattgtcttttcagttctcaccattgtgcagtggctcaaagagatatctatcttctactggggcagatggcactatttgtttttggctctgggatgctggaacccttaaaataaagtcagtttctattttatttcatagattaaatgtgtttagtttaatgagtgaaattgcaaaagtataaagtagtcg

SEQ ID NO: 15263 - DNA, 1205 bp, Homo sapiens
tttttaaatatcattctgcatgtcagatttcgagtgttcaagtgttactgatttatgaaaagtacactgggttccagttttaagtgcctttgtaagaaaaactatttcatagacagcttttaaggaaataacatataaatgctttaggtttttaaagagcactagccagagagtaaataaatctgagctttaatcctagcttcatgccttactttgtgatttttggacaggtcatttaacttacaaattaagttataaagtgagaatgatagtgcctgacttatttcaggtgaaacaatgtttttattcattactttaaagacttttaactagaagccatatatatcagaaagcttctttatttttacctgcacatgacaaattggagtatgtgaattcttaaaaggtgatcatgtaagaaaattaatttccagattacatttattttccttctttttcttggtagcggatactctgttttcaaggaagctgaatgggaaatacagacttgagcgacttgttccaactgcagtgtatcagcacatgaaaatgcataaacgaattcttggacacttgtcatctgtgtactgtgtaacttttgatcgaactggcagacggatatttactgtaagtaattgctaaagtattatttatattcatatatgtaattgaggaaatattgcttataggtgaacttgaagtaaaaccttgcttttttttcttttaataggaaaccggaaattcaggtggtttcacttactctaacagaagagtttagttaaatttggactttatccaaattcagaaagtttctaaatgacatgttgcagcacagtcacagttattatatggttgtacatcatgaataagtatggttctcaacatatatcaaatacacagtttgacattttgcaaaatggcataaaataattttaattttgaactaaggacatctaagtatgttgagagattattaaatgtgcctttttataattgtatgagattattgaatatacctttttatattatctgtagaaaatcacttgcttgtctatgagaaatttcccttaaaatagtgattttaaaaaagctaaaaaattctgagcatatctaatactcttattacctgttattcttaacagttcattcttcaaaatatctgatgttttgtttatagagcctctttgggtttgtttatttgttat

SEQ ID NO: 15264 - DNA, 2422 bp, Homo sapiens
ttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagc

SEQ ID NO: 15265 - DNA, 1142 bp, Homo sapiens
cttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaatatgatttttttttgttaatcagtttattataatgtaaactgtctgctagatgtttatttgatttagttaattctaaattgttttctgctgctaatttcttatatagaaaaaatcaaactagaacttgggtatctaccatttctggtaaaaagcttattttctatagtagcatatttttactttaaaaattagctgcttttggaagagcttttcattcagacataaaacataccattttcttctaaattattcttaacataaatggggaagttcttgtattctttcatttaaatcattcagtccttactataagtttctttatagaagatgattataagatgtcataaatacagccttttccagtagctttcataatttctctattatcacagatatgttgcatgccttatatctagaaactgatgaataaagattgtgtctcctacttggtaaaactttgtca

SEQ ID NO: 15266 - DNA, 1299 bp, Homo sapiens
agataaagaaggccttgaaggctcatatgtatgtttattagtagctctgttatatttctctcatagaaagattgagttatatctcatgataggtaatgcttaaggccaagcttcgtgtttaaaattctttattatctctaatagtttataaaataatttcccaactgtaagaacaagagagaaataaatgtattatatttagaatacatcaaaatacatctactgatgtgacagtacatttaactaaaaaattgcaaaacagatttgtgttttttaatttcagactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacatttcaaagttgtaaggttgttttctttaagcaaatgtattgttggcatggcagcaaaattcttaattagtaaaaagtagattagggaagatgtgagactagaccttagtaaatgaactttgaaaaacaaatcctgaagggtttgaattccaaaatagacttcctaattatttccggcaccgataacagtctataattttaggactgaacttggctctttcagatattcataacgtctgttgtttttggtatttagaatatcatgctggattctgtgttgtaagctgtatagggcatgccctcactgtatgacttgctaggtaatggataattgtaaatgtggccccagagtctcttgactgaatctgatagcttaaagtatcctcacatagcatccttttctcaatttttaaaaaaagattttaagagattttattttttatagcagttttaagttcacagcaaaattgaccagaacgtacagagttcccatgtatcctttccccaccccacccccacacatgtataacttcccttgctatcagcatccaccatatcaacattccacaccacaatggtacatttatcacagtccgtaaacctaccttaac

SEQ ID NO: 15267 - DNA, 1241 bp, Homo sapiens
tcatttaaatgtggaaaaacgaaatcaataaaaatctatatatgcttattaagcattttaaggagggtgtgaataaggagtgaaagctttgagcagtgactacagcagtttttcgaaagtcaaaacaataaccaatgccaatcagtagctctcttcacctctcacacaataatagagacaggacaggataaaaaagggttacatttaaaaaaaagtatggatgttaaaccattggaaatggcactgtaaatgacaccggaaaagatcgcctccaggcactgtgtggaactttgcaaactcgggtcctcacccgaggaccgcacggccgacctcggggaggctccaccccagaaactatttcattggcgccacctctagcccacacttcccctcttccgcatgcgcacaaggagcagaagccgaccagctcgtcacgtcgccttccccgcccctaaatttccagttccgattggtctgtttcatgggaccgcccctctggcccgaccaatgtggaagcctcctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatat

SEQ ID NO: 15268 - DNA, 1793 bp, Homo sapiens
tattgtatccatggaaagtgatagttcctcaaaaggaaattggaaggcaaatacatcctgcttagtttataattaaaagagtaaagagtcttctttcccttcctcctttcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcactaatgtgtgcttgacattttttactatattgacatttattatggaaagagttaataattattttttctgatgtgctacactagtggccagtatatggttaagttgatgctgtatttattctaagacggatttaaaaaggcagttttctaaatatgaacttgtgaatttttgtatgtgtgtttgagtaaattgagaaatgaattttataaatgttctattgatgttgcagtaaagaagccttttgaagtaattgatttcatttgaagctttgattcttctgtatatgttgacatctttaatatttacagatgctgtaaagtgatgattttcttgctgtcctccgtgctgcctgggaagcact

SEQ ID NO: 15269 - DNA, 1143 bp, Homo sapiens
tctgagaaactcgtcagtccaaggcaaaccacaggagggttggtcttcctactgagaagggtgaaatgttggttgggaaggtgtaattgcattcccacagtactgtaagaaccagggatacggacaacttagttcttatcattttaatttgagagaagaatagaatataaatataaaaaggaatagaaaaaaattaaaggatgatatagcatctaggactttgtgcaatattcttgtattttaggaaatgccaaatttaaaattttctaaatattgttaaaaaaattgcattttaaaggagaattggctaggtatgaaaaaggatttccttcatattttttgaagcataatttgtttttgtcttctttctagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggtatgatttctcttttatatctgttcctgtacctcattcagtcctcctttaaaaaatttcccacccttactgtgaaaccccatctctactaaaaatacaaaaaattagccgggtgtggtggcgggcgcctgtagtcccagctactcaggaggctgaggcaggagaatg

SEQ ID NO: 15270 - DNA, 1099 bp, Homo sapiens
ccagactgatgatatcatagtagcccagtttggttacgcacatattttctgaatacatgcaagaaagggggaagagaaagggaggaagcaaataaacaagcagattatgaagacagtagatttatatatttttaatccaagttgaagaatttttttccctttgggcaacaggaagtataagttgaaaagttttaaaagctagtatgacactagatttgctttttagaaagggaactttggttgcagtatggaggatgtgtttgttgaaagagatggaatcatggataattgagaatccatccaccaaaaatttcctgtataatacagccaatatattcagtggaaaatgtgttgaagagaggatgtagttcttcaaaaacactgaatatatgtgaaaaagatttccatatttttctaactccttttctattccatttacttctcaatcattttagtagtttcagtaaagccttgattaatggtagtttatttttttttaacagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaaggtatacttgtatatattaaatttcattttttagaaggaacaatcactgaattttcttgttttcagtagctgctggtgcaaatttaattgaagagctgttgccaagacctatagagaccttagacataatcatgtttacagattatgtctacagataatccagaggtagaatttgttatacttggagtgatgaatgtttcctttggtttataaactgacatttattgaaaatattgaaaatatctatacatgcactcacaaagtttattgtctttcttttttttttttttttttttgagatggagtcttgctctattgcccaggctaagtggcaaaatctcggctcactctaacctccacctcccaggatgaagcagttctcttgcctcagcctcccaagtagttgggattacaggtgcccg

SEQ ID NO: 15271 - DNA, 1213 bp, Homo sapiens
tgaaaaactcaaaacctaaatatctaacagttgagggaatcatctcaaaagttttgatgtacttatggaatagaatattgtggactaattaggattcatctaaataaaacaacaaaagcaagatatagtatgtttattcacgattctcaaacttcgtgtgatatgtacagatatatcttttgaacggatggcaaagaaatacactgtcatgtttagttacttatctctgggtagtgagataaaggatgatttttccttgtttatacctccttgcattttcaaaattagctgtagtgagtatatattacttttataattggggaaaaaattagcattgcaaaccttgtggttaatgagtttctttcatcttttatggtcatttaattaagaaaatgttagtatcattttgttctgtgaaaaatgatttttcctctttccactaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggtaaaatatcatttcaaaataaatggtaatttagaggctgtcttagatactgacttcttcaatcttttcctaattaagggcttgttacatagactgctgtaaaggccaaaattcattattttcaactgtcatcgctatcgttgctttatcaaaacaggaagagcatatggctttaaactaaaacagccacaggcgcctggaagaataaggagaggaagacctctgcaggcttagaattgcgagtgctaccattttacaaacaaaatgtcttgctttcttgttcttaggacaatattgcataatttgtgtgcattttatcctaaatagtctgatttaggttaaaagtgttgtcttgctccaggatatctactatactattaggctgaggtattttactatttctgcccatagtctagacttctgctgaagtcataaatggagatgtcatcaagtaaaaagaggaatggaggagcccaggaatggagataaagcttgtgtttcagggtctgagttggtgcttgacagtgtgaggtcaggt

SEQ ID NO: 15272 - DNA, 1885 bp, Homo sapiens
ccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcctgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaatgttacattgtaatgcttggtcttggggtcatatgattatgtgtgacgaatttctaaaatattctaataactgctaatttcagtataaacatcattcatttaaaacatatgtggctgggcacagtggctcacgcctgtaatcctggcactttgggaggctgagacaggcagatcacctgaggtcaggagttcaagactagcctggccaacctggtgaaaccctatct

SEQ ID NO: 15273 - DNA, 1179 bp, Homo sapiens
ccatcgccttgggggtgaggatttcaatgtgaattttgggggactcaaatgttcagaccataacaccaactatcatatcatattggtgtacttatcctggacccagaggaacagcagtcatagtctagataaagaagtctcttgggcttcagtgtctccaatcagatgcctctccagagggactccttatcccaatctaccacatcattttcttaatgactacgggagctgctctgatattactttgtcttgtattaatgccagcaaatatcttaggtccattatggtttatgcatcaatgcataatttctatttagttttcatgtttttgagcttcatagcttgttattatcatttgttttatacaatcaatgttcatgtaaacaggtaacataggtataataatagggttgtaatggatatactgaggctttagacaggaggaagcatttgaggtaagacataaagggcagagaaacagggaagaatatcttgaccatgtgccatggaagaataaaagggtgtggtatgtatggacaatggtgagaagttttgtatgcctaggagtacataagaatcaaaggctacaacttgggagaggaatgttgaaacaggtaactcagaatcatataaggcatttcctgacctattttaaaggtggaatcacagcaggtcacaggtgacttactcacattcataattttaaaatctcttctaataatgactttttatttttatatgtactgacattgataataatgattatatcttctttcatttttgtgtctttaagtagtttccttccattcatcatctgattttatcctaattatctctgagtggcacagctctgaaatattatagtattctaatttctacagatagggaaactgagatatggagagcttacatggtttactcacagccacatggccatgcttccagtgacgcagacttcggatttttaattgcatatacttgtcagattttatatgtatgctttttgtctattttcctctcaaatactgttgtgtgtgtgtgtgtgttttttctctataggacttggcctttaccctggaagagagacagcaattgaacattcatggattgttgccaccttccttcaacagtcaggagatccaggttcttagagtagtaaaaaatttcgagcatctgaac

SEQ ID NO: 15274 - DNA, 1056 bp, Homo sapiens
tactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaac

SEQ ID NO: 15275 - DNA, 2821 bp, Homo sapiens
tgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtc

SEQ ID NO: 15276 - DNA, 1372 bp, Homo sapiens
gtggagcagctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaattactgtgagtgaatgtttcgggtttgtgcagggtacaatgtaagggtttttggatcagtgtaagagtggagagacaggaattagaagtaattgttactaagcaaatcatggaatatttagttttgatgtaactataattttgaaagcctggatgcttaagttgagaaatgggggaatgagatacagaaaataaggagcac

SEQ ID NO: 15277 - DNA, 1372 bp, Homo sapiens; identical to SEQ ID NO: 15276

SEQ ID NO: 15278 - DNA, 1372 bp, Homo sapiens; identical to SEQ ID NO: 15276

SEQ ID NO: 15279 - DNA, 1178 bp, Homo sapiens
aatgttaaatgctggccgggcacagtggctcatgcctgtaatcccagcactgtgggtggccgaggtgggcggatcacctgaggtcaggagtttgagaccagcctggccaacatggtgaaaccccatctctactaaaaatacaaaaattaaccaggcatggcagtgcgcgcctgtaatcccagctactcaggaggctgaggcagaagaatcgcttgaacccgggaggcaaggttgcagtgagccgagattgcgtcactgcacttcagcctgggtgacagtgagactgtctcagaaaaaaaaaaatgttagatgctttcctagtagaaggtagtgcttctctgggactgaaaaatattaattaataaaatgataaatcatattctgattttatttggtatttagaaaattgggatctgttttcttgcattttaacttaagcatgcatataggattggaatataaaaccagttttaatttcaaatgtaatgactggactgatgtccatgattattaccttactgctccaacttttcttattataactttttttttttaagggaacttactctcttttggagtaaattacaacaaagagtagaaccatctatacaagtgtaccttgagaggtgtcgtcaactttctttgttaacgaaaacagtatatcacattttcttcctgattaaagttattaattcagaggtaagaataatcagaatatttttaaggttaaaatgtgtacattatcattaataaaagactataacttttatgattttggctcccttttcagtgatttttaaattttttcagttagtcctttgaacattttcttgttagtcctttaagatatttgatacagaaaaacttaaaaatgcagttgagaaccagggacttgttcttagccagaagaaaagtaatatgtaatacttaaattatatcattcttctgttttggttctaggggttatactactttgataatttggctatagaaatttaaaaagtaggctgggcgtggtggctcatgcctgtaatcccagcactttgggaggccaaggcaggcagatcacaaggtcaggagttcgagaccaacctggccaatatagtgaaaccctgtctctactaaaaatacaaaaattagccaggtgtggtggcgtgcacctgtaatcccagctactc

SEQ ID NO: 15280 - DNA, 1180 bp, Homo sapiens
ctgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagt

SEQ ID NO: 15281 - DNA, 2261 bp, Homo sapiens
gataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaatacatgggttttctttttcctaaattaacaataatttaaataactgagtaattttaatattaaatttttgttaacaactgaatgtttccatacagttttcttagaaattgacctagctcttaaaggtgggcacttggcaaaactgccctatatagcacagtagcaagtaggtttatttctgatcattgtaactatgagccactgttaagtgaaaatgccaatgtattggggcttttcttttgctcattagcttaagaaaatttataactagacatttctaattgttttacatgtcatggggaagagtttgccaacatttaatgaaatttttatattccaggtaatgtatactaaaggtaattatgagagtgg

SEQ ID NO: 15282 - DNA, 1214 bp, Homo sapiens
agaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaagaaagaattgtttaatcactttatattatagatatgaccattaagataatgcacttttattttctatatgtagaaatgcacttttattttctatatgtggaagtctatcggttagggttctctggctgcaaatcaactcaactctggcaagccttaagcaaaaaagaaagaatttttaagaaggtccacaatcagggctacaggcgtctaggttctaagaattaatggacagttgtcttttcagcttttgtaaagatctggctttacctattactgttcctgtatggtttcactcacgattcaaatactcgggaagacactactgatcttggaaggggaaagtttcttcaaacaagtagagagggatattg

SEQ ID NO: 15283 - DNA, 1200 bp, Homo sapiens
accagcctgaccaatatggtgaaaccccatctccactaaaattaaaaaattaggcatggtggcacgcacatgtagtcccagctactcgggaggctgaggcaggagaatcgcttgaacccaggaggtggaggttgcagtgagccgagattgcaccactgcactccagtctgggtgacagagcaggactccatctgaaaaaaaaaaaagaaaaaagatggtataatcttcaggaaaactttctggacctctctgttcttatttataaaatgagaggatttattaagagattgatttcaaagctagactgtctggaaagtaattatttctctgtttaatagaagaaagtgaaagacttagaaaattttagtgtttgcaatgataatccttaacagtgtcttataaagtaagcattaaaataaagtttgtcttatgttgaaatatgatgtattgaaatatatttgctaaataaatttcacttttgtgtctgtctttcaaaactagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataaggtaaaaagaataagttttaccagtgaaataggatgaaaagaaaactgccaataatagattgttaagataactgttaacaataagcctctacaactctctgagtactatattgaacatattccttcacatactttaatatttttacttaataatttttgtagtgttttatagttttacagtgattttgtatattacctcttcaggtaaaatataagctttatgaaaagagtgatcatatctctctatgtacttaatctctttatatctttactcaatagaaaattataggtttataatgtaaatttttacagaatttgtagactttgtagtaacaatgtattttgactcttacattttgatttttctaatttttatttttttgagaaggagtctagctctgtcatccaggctggagtgcagtgacgaaatcttggctcactgcaacctctgcctcccaggttcaagtgattctcctgccgcagcatctcaagtagctgggacttcatgaggtgtgccgccacgcctggctaatttgtatt

SEQ ID NO: 15284 - DNA, 1133 bp, Homo sapiens
aatttttttttttcagatggagtcttgctctgttgcccaggctggagtgcagtggcgccatcttggctcactgcaacctcctcctcccagttcaagtgcttctcctgcctcagcctccggagtagctgggattacaggtgccggccaccatgcctggctaatttttgtatttttagtagagaaggggtttcgccacgttggccaggctggtctcgaactgctgacctcaggtgatccacccgctttggcctcccaaagtgctgggattacaggcacgagccaccatgcccagccagtctcaaatatttttgatgttatacatagctttttaaaaaaataataaaaacttaaaactgttttcctttgattatgtcaagattgtaaacaacaaaatttgagtatgaggagggtagtgtgtaaaagttttgaaataatccactaaaacataaagtgcatcatggttctttagcaaagggaaagaaaaccataactgcttaaatgtacagctgtgctccttctagagagcataatgctctcatattcttcttcaagtgcaggttgggttttgtgaaccccacacacatggtttgtttggcctaaaactatgacaggaggatgcagctggagaatatgcattggcttaaagaataaactgctttttagctacagctaatttctggttcaaaaaagacataactaaaggttaaaatgtctactagattctttgtcccatgtcattaacatgtagtttgctacatgttaataaacctaatatgcctttgaaatatatctaatatgggctgaatgaagtgcctcattcctataatcccagcactttgggaggccatggtgtgaggatcacttgagacaaggagttcgagaccaggctgggaaacatagtgagacactgtctctatttaaaaaaaaaaaaaataataataataattaggctgatgagggggcttatgcctataatctcaacactttgggaggctgaggcaggcagattgcttgaacccaagagttcgagaccagcctgagcaacatggaaaaaccccatccctacaaaaatacaaaaaaattagccaagtgtggtgggacgtgcctgtagtcccagctacttgggaggctaa

SEQ ID NO: 15285 - DNA, 1243 bp, Homo sapiens
gcgcaagcgctctgaggccgccggatttgaatcggcggcgttgttattgacgccatattggggccggcggcgggtgggagagttctacgagggaggggaagcggttggacgtgttcgcttgggttcctgctgcggcagctacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacaggtgggacccggccccgcggccgccggggtagtggagagaactgggaacaggggtcctggggtgtgggatgcggcccctggggtgggggtgccggactgtgtggttcttgttcttagcaaagtagtagggcagccacgtttttcactaggtcctcgtagcccgaggacctaataagacacaatagaaatgggctgatgtcaaggggatagtgtttggaggtgggtaggggctttgccttgcccgtattgggtagaacagggacatctttttctttgggccgaatgattggaattgtttccgtagtcgctggagccccagcggaaatgatcagagaggacgatattattcgtaaatttaggcgaaagggtcacatttcacccc

SEQ ID NO: 15286 - DNA, 1814 bp, Homo sapiens
ttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaa

SEQ ID NO: 15287 - DNA, 1183 bp, Homo sapiens
tgcagtgagccgagattgcgccactgcacttcagcctgggctacagagcgagactccgtctcaaaaaaaaaaaaaaaagatgtagggtagtatctttgaaaagtatagtttaaattgagagtactttatgaacacttgcatttttagattgcttttccatttaaaatgttttaagaggctgggtgcggtggctcacgcctgtaattccagcactttggaaggccgaggtgggtggattgcttgagcccaggagtttgagaccagcctgggcaatgtggtgaaaccctgtctctactaaaaacacaaaaattagctgggcttggtggtacacacctgtaatcctagctacttgggagactgaggcaaggtaattgcttgaactcaggaggcagaggtttcaatgagctgagattgcaccactgcactctatcctgggggacagagcgacacttggtctcaaaaaaaaaggttttaagaaggtgatatttgagaattgttaattatagaattttaatctgaaacatttccttttatggaaatgattacctatctgtgttgtttaggaagattcttacctctgaagacaatgttaggaccaagatatgatagtcaagttgctgaagaaaatcggttccatcccagcatgctctcaaattacctaaagagcctaaaggtaagaaacaaaatttatttttgtcactgatttaatatactttgttcagtcttgttcttcaggtggcttttaaaaaaatcttattattttaaaataattaatagactcaagggaagttgcagtaattgtacatagaattctgtgaacccttctcccagcttctcacaatggtgtcattttatataattgtagtacaatatcacaagcaggaaattgacattgatacagtactgttaactgattgcagatcttatttacttttgatatgcatttgtgtgtgtgtgtagttcagtacagtttgatctcatgtgtaaattcatggtagtgattatagaactgctgcatctccacagaggaattccctcatgctacctctttatggtcaaactctctcctcaccccgtccctgtactcgccagagtagaaaaacaaaaatgtgtagtttttccatttaagagaatgcccacctgacatcccagcccccagcaaaacttactatagcctccacta

SEQ ID NO: 15288 - DNA, 2717 bp, Homo sapiens
aggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtacagactggatgtaatttgtaatcaggtatagtccatgttttactttaagcagtacatcacttaataaccattgttaagccattgctttcaagaatgttaactgccaatttaaaagcatgtgtcctaggttcatgctttggtaaagctctcatttcaagtgtattcatagctaagctttctgggagcagaattgtctctttggtgaaaaggaagtacagcctttcctgtttctgaggttgcttaccatacatgtatgtcactgtttcattggccctgttacatccatttggtaaaatttatttgtcctgattaaccagctctcattttatggaaatgatgataaatctcactacttaaatttaatttatgc

SEQ ID NO: 15289 - DNA, 1819 bp, Homo sapiens
tattgcagccttgataatgggtactgaccactttgaaatggagattaggtgttgccacacttaacttatgtctcagtagctcctcacagcaagaagcatcaatcatcttagtgaaatatgcctatagggcagttctgttccagggaagcattgtctctgtgggtcacattaaggccttgataggaaggtaaagatttagtgtgaatgattccaagtggatgatggggagacaccactgtagggaaagcagattttcctgtctatcccttttcctttttttcagtgtccatcctcctggaaggggcactcagaaagacatctacctccttcttagtagagttctgaaaattctcttttacttagtaataaaaggtaggttcatatgcaggaataagacacaggagatgtaaaagttagcaaaagagatcacagaagagctagctaaggatgctggtttaatcgctgcctccccatttcaaaatgtcttttgttgacaggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtccca

SEQ ID NO: 15290 - DNA, 1193 bp, Homo sapiens
gccatgaagtcttaagagccaagtgctgtgtgcggctgcccagcacaaaccgtctcactcttttcattgtccataggcttttgcttttttaagagtaagtttttttttaagtagggtataatttatgcacgtgatgcaaaattagtgtaaaaaaccaatcccctaaaagcctacatcctattcctgtccccaagggaccctcctcagagcaaattggtgttaccaattccttctttcagagatattttctgcatatatgacatatatggatgtgtgaaagtgtgtttctttgccttcattttagatataaaagtatatcatagagattgttctatgtaagtatatagagtcccggttctttttaatagctgtattgaattccattcttgtatggctacacctgatttacttatcctgtcccctatagatggatattatgtttactttgagtccttttgtcatgacaggcaaggctctgatgaatttccttgtatttctcagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatggtacggtcctgggaaagctgctgcctttgcccactgagctctctatgagagcttgtgctatgtgacctataataatgatacgtatttgtggggtacagtgtgaggttttgatacatgtatacaatgtttaatgatcaagtcaagtcagctgtgcctggcagctgattgtatacacttatatcaggggagagaggaaatggctttgtaaacataagaaatgtgcagaaatacagtttgtttttggtacaaaggtatctgtaaccaagtgaagatggttaagatttcttggtttagtataaactctttaaatatccttaaatataatagttaaaaataagttgttcacatccaaaccccgatatcagggtttcttagtactggacatttctttcttcttagtcacctctggataggtccctgcactgacaggtgctatgaatttgaaatatgtgttttctccataagtgcaaaagggaggaaaaatgtc

SEQ ID NO: 15291 - DNA, 1245 bp, Homo sapiens
tatatattttctcttacaaaattaaactttctgattgagagtcactactactttttctttttacttctgctcagcaggctagtattcttctcaggttattttcctgtataaaatagtttttttcaacatttcacagttattactatgtctgactgtgttctctccagagcctgttctgcccttactcaaggactttttccaaaatactgtccttctagtatacttcatttaggtttttgtcttggcaaagtgacaaatgaccacatgccagaggcttctacaaagtcaagtcatatgttaaatctgatgtcaagctgtgaaactgcataactattagcaccaaagaggagaagaatgtcagaagtctcctgtacttccagcggatttaagataatgagctagaaaaagaattcagtatgtgtttaaattgttttcctgtggcaagaatgaaatctccttttaaaattgcttttgtgcctaattgttcacttcctttttcttttttctaagggattttgcttgcccaaagaatttatggaagattcagctggagagggagcaactgagttccatgactatgagggaggtggaattggagaaggcgagggcatgaaggatgtgagtgaccagatcggaaatgaagaacaggtacgttttcacataggtatacagttgacagaagatcactctctttcttttcaacatgtaagttacacataaaaatggtttttactaggttaataatttttaatctgtgatctacagagccctagatatattggtgcttcggcagtgggtgtaaataaaaagcctaaaatccacaggaaggaacctggcaactccatcattggttttggctataattatggaggaaatgatttttactttttttttttaaatgggcagatatttactgatgattttctagagtatttttgatagtatttttaagcataaaaggcctggctatcttaagtgataattgcattaaacaataatgccaaaatttgctgttaataggttttactgttgtatatctttaaggcatagagtgttttaaaaaatctgtatccttttttggttggaatcaagcaaccttctgaactattcagatgctgtgaactaagattgttacattgcttggattttttaaatgcctgtctcatttgtgagtgatttatgtgtattgggtgtatcacttatattctaagttaaatcagatcagaaacttgtatttaaggtaat

SEQ ID NO: 15292 - DNA, 1117 bp, Homo sapiens
tcttggcatgggactgtggccagattctgtgccctcagctctctttgctactgaagattcacacctgtctacagtccgaagagatggacagatcttagtatattgtctcaacaggatgagcatgaaaaccagcagctggacaaggtcagtggagccttcagcttgtgtctctggtttcttggctggtttttatttttgctggaaatggtcaggacacaatatatttaactggagcattctgtggccatttattgtgtagctgtcatagttttattgttcattgtgatattgctccctattgattatttattaggtatgttttaactttcttcctctgtgggagactctccttttctctcttacctttgatccaatatttgtgaaagaggttttctcagttatttggaatgtgaaataaaaggttattctagtactgagtttgttcattcaaatgaatttcaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttggtgagtagaacagcttaatttgtccactgatgtgatttatatacacttatgctatttaagtgcctcagcagctgtgttaatctgtgactacactgttaaaattacagttgggaggtctcctaggaagaaatttgtggtctagcattactgttaaggagcaagtctgcctgtagatgtgtcacaagataaacttttgtttccatgttatccttagcatttcaggatatagtcaccttcctaacaaattcaaaaggaaagcatactgtattattttactttttagttttgaacatctgctttttgtgctgtactactgctacagaaccattctatatgggaaaggtattagttttgataaatgcatttcctctaaaagtatataagattctaatcttattttagttccagtgctccatgttgtcacacttggagtt

SEQ ID NO: 15293 - DNA, 1163 bp, Homo sapiens
tcattttaattttttagttatgaacaaagcttctctgaacattcctgcttatgtctttcgacacacacatgttcattggtgtttggggatactagaagtcatattgctgaggcatagggcaggtatatggttaattgtaataggctgtcctagttcttcagatttctacctcaccagccgcgtatgagagtttctattgtttcatattctccatatcccttggtgttcccggtagacacttgatgattcctctcctccttttcctcctcctcctcccaggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtgagtaggccaaaatccctagaggaatatgatttgagttgtactcattagaatctaaatatttatttttccttggataggtaaattgtctactcagatatccacattggagtgtaactttggccatatcgtgtggactgagggcatgcggagactcgcgatgctagtgggaagggcattggaatttggtgaacctgtgctgctggttggagacactgggtaaagatctgtgacagtgactcatgagggttcatttcaattccataggattacttgagttatcactgaagaactcatgaaagtattaatccccccttctttcctccttcctcttttttcttttttttttttttttttaagaagagactaagagtgggtcgggggctgggggagggatagcattaggagaaatacctaatgtaaatcacgagttgaggggtgcagcaaaccaacatggcacatgtatacctatgtaataagcctgcacattctgcacatgtaccctaaaaaaaaaaaaaagaaactaagatctgttactgtttagtttcctctaccttcagactaggttctttgttaatggaaaataatggctttattattattatttttggagatggggtctcactctgttgtccaggctggagtgcagtggtgcgatacggctcactgcagccttgactttctggactcaagtgatcctcctggctcagcctcccaggtagctgggactgcaggcatgcaccaccaca

SEQ ID NO: 15294 - DNA, 1196 bp, Homo sapiens
tgtaacagccggcttttcttgatgcctgagctaagatagttaaggggtgatgcataaggtgctggctttctttaggttctgctaatcttgctggctgtatacaggactagggccaattttcaagaggggaattgaactgctgctttattttctaggaattcagagaatggggttagtgttagccaaaaggaagttgggaatagtcaacagaatgtggtgatttaaatgaaattagactgcaggggaaagattacacaagaaatatgaggtattttcagccttggcttcttttctgtggggaaaaaagggactattttaattgaaaattgttcctccttgatctgcagtgtcataatttgttttgaggcaagactagctacagaaagtaatttgctttgaaatttgatgataacctaggatttgttgatttgtacataatgcattttaaaactttgtactgatttatacactagttcttgctgtttgtttcttcctaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtatgtagcatttgtctccttccttcaatttgttaacacatcagatagtagatttttcgtagtaagaatgaaatgtttttacttctcctttaatattttatggtgaatgtcagagcctccatattggaaattaaaaggcaccttttactgcattcttcctgtgctttgtctaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcaggtacttagtttcaaatggaatgtattgattatacttggtgatcaaaatttcatggcttcttttgttagaaaaaagaatctgtctgttgatgtatttttccaagtagagatttttttttattttttattgtttttaatttttttattatttattttttgcaagacacagtc

SEQ ID NO: 15295 - DNA, 1196 bp, Homo sapiens
gcccaggctggagtgcagtggcgcaacctcggctcacagcaggctctgcctcctgggttcacgccattctcctgcctcagcctccctattagctgggactacaggcacccgccaacacacctggctaattcttgtatttttagtagagacggggtttcaccatgttagccaggatggtctccatctcctgacctcgtgatccaccggcctcggcctcccaaagtgctgggattacaggcgtgagccaccgcacccggcttttgtatctttttcttcttgtaaggactatacgtagaagacttattgcatagaagaagcaataatggtatatttttggtaatggttacattatcctttaattatgctaagtttctatatcaggttgaaagacattttatactacaagcagttaaaatgagctgacatagcttcttctgtttcatgtttttctattgtcaacatagttatattaacttcctaaaaagtgtttattatgtattgttttacaggttcacagaactttatgtagaagaattagaaagcaaagaagacttacaggttcttattgtagattatctgaaaggattgagtgtgaacaagaatacagtgcaaggaatcataaagtaggttcccttttgtatgtctttataagctctttctctgaacatgaaaatgtgctactcgtgcacacacacaaatatgtattcttttttacttctaacttgagaaaactgatggcaggattattatttagattctcttgtaaagttggaacctgatatgaactcctttaggtttttctaaggaaattacatagaaagctatgaatcattacctatgagaagatataaaccatcagataatgctctcctgattacctctatattcatagctgagggtttgaattcttggagatgtacatggcttgcgttttgaatctgtcttgaagaaggttgcttttctatttgcaatatttatactagctatgtgggatgtaaggagaaaagggttaatataattgattgtgtcaggtttggaattaatggaagcttagcctaataaataatagagtagttacgtggcttgtgctttaatttgagactgttattcctgttttttgtatgccatatggacaacatgcaatcttttgtgtcagacaacctcaattctagtattggttctatgagaaactaatt

SEQ ID NO: 15296 - DNA, 1217 bp, Homo sapiens
gtcttccttactagacagcaaactcctcaagaagagtatctatttggttttgaatcccagttattaaactacagtatctggctcatagaactgaataaatgtttgttggaaatgagtgccttttccgttgtaaacacttacattaagtaccccccgattttgtaggtaattactttagatttttgtatcctcttagtcagaattatctcatgccattgtcctggttcctgaaattgaacaggatacaattttacgactaagtagattcagcattcattcccctatgttctcagacccttgggagttctgttttgtggtttggtcagagtagagaattgcgttctatgatattcccaccaatcaatgaaaatatagatactcctttttgaaaatagcttaagttgaaaatgcatttaatactctgataaacctattacaaagcagaaaaattaagtccaaccattgttaagttggggatgtctgtattctttgtgtttgaaggtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtgcgtagctgttagacttttttgcacttctagtgtggggatggtacagggcatgtgtggagttgtgtgtgtcaggagggaaaggaaaccatttaaaatttgttatttttgttcttgtggcttttggggttttacttcctttctttaatcatgtgtcattgcagaggaaaatgagatgatatgaatggagtttcacctttttcatgttccatcaagtaaatccattgtgcctgatttgtattttctgttcttaaatgtgttgtaataattgagatttccttttctagtgttcagttggctagtggattttatttattctttattatcaactgcagataaactgaatttacatactttctttttccctaggtatacagccaattgtcttgctttggttacctgtatgaatgaagagcacaagttatcatttcttaagaagatatttaatagtgatgaattgatccatttcaggttgaggtaagcaggaacct

SEQ ID NO: 15297 - DNA, 1239 bp, Homo sapiens
aaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaaggtaatagtttgtattatcttctataactttgcattttatgagaatgtaaaatacataagatgaattggtgctttttcttttttgataacataaaaagtagcatattactcagcccctgttatctagaagtgcacatggagggtttttttgttttttggttttttttag

SEQ ID NO: 15298 - DNA, 1217 bp, Homo sapiens
gtgaaaccccgtctctactaaaaatacaaaaaaattagtcagacgtggtggcgggcacctgtagtctcagatactcgcgaggctgagacaggagaatggcatgaacccacgaggcggagcttgcagtgagccaaggttgcaccactgcactccagcctgggcgacagagcgagactccatctcaaaaaacaaaaaaaacaaacagtgaattgcctcagtatttaattttttgttatatgtaatatttaatatggacatgtcaaataactaaactttaatatacttttatcttctataaatgtgtttaatatatttttctcttctacagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgt

SEQ ID NO: 15299 - DNA, 1216 bp, Homo sapiens
gttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatgggaaaataggctcctaaaggttaagacttctgcctgagtctgcttttccatcatcatctgtttcaggcagaat

SEQ ID NO: 15300 - DNA, 1926 bp, Homo sapiens
ttcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagatag

SEQ ID NO: 15301 - DNA, 2229 bp, Homo sapiens
catagatccagctatccagactatcttgtgagagaataagctcaccccagcaccagaaagatttgagcagaggaatattcctgtaatgaatagaggattgtttgattctcaggtatatttcttaagccaagattgaatgcagtgtcaggcactgccttaacacccacagagataagatgaacaaggtactatcactgcctaaaatgagcttacaattaagtggatagacatataaaagcttcctttcaattcagcctgagactgtttatatgcatgtgctactccgaatgacgtttgtatgggtcaatgctgatttaatggggaaaaaaagtagaaaatttccccaattgcttagctgtttgacatgtttctgagctgcaaactttgtcaactcttttgacccaacatattattctctccgtattatctcttctaaccacaatgcattaagaaataatatttttatgtggatgtcctcctcaataagtaaagatctccatccatatttaattaattggtaagacagtcaaattcatacatttacatttactttgtcaaattttttggtctataaaaagcatagagatctaaagaggatacactgctaacaagtttagaaagcacctgcttttttttattattattatttttgtgatagagtcttgctctgtcgcccaggccggagtgcagtggtgcagtctcggctcactgcaacctcggcctcccaggttcaagtgattctcctgtatcagcctcccgagtagctaggattacaggcgtgtaccactatgcctggctagtttttgtatttttagtagagatgggtttcactgtgttggccaggctggtcttgaactcctgacctcaaatgatccacttgcctcagcctcccaaagtgctgggattacaggtatgagccactgtgtctggcccacctgttttttttgaaggcagaaaaacattcaatattaaaagcattcaatattatttcaacctgccttggctctagtgaatgttcatgatttgaaagaactgaaagacctaaaggcagtgtctctattgttgactacaaatgtaggctctttgttggactatgactataatcacacactgataatatgacgcaagtagaggcagtactactaagtatctagcaggtgctttgaaaccccattactaagtcccagaagactgtttcctaaatttgaagtggaagaattaaatgactcaatggaaccctttagctgtgggtccattgatgtgtgagttttagagctggaaggaattataattttgttgtttataattgctataatatagaaattataattgcttttctttctacttatgagttaactagatccagagatatttattcaagacacacattcacacacacatacacacacacacacacacaccccacagctagtgacaatagttaagatttggatttaaggatcctatctttctttatcccactttcttttcaatcgcattcataacttattatagaattatgtctcaatttttacaaatgtgaatgtcttattggtatttttagggcctatagaatggtacacctcatgtagaagaacttcgacttttgaaggtatacaataaataaaacatcaaacttgttagcattcgttctggtttaaatattttaggagttgagttcagcagaaggaaatgggctatcactacatttaagtgaaatacaaccctcaagaaagtgtatggttcacagccactcctttaataaatcctgtgggttgcaattctttgtaagaaactcatgaaaaagatatattgattcaacaaaattggtttgctgttgattatacaaaccaataattatgcctagaattaaattgtggacacaaaaaagggaacagaccatttaaaatgttttatttcaaaatatcgaaaagctattaccttcaatactctaaatatttaaatattaattattgtagacatcagtaagaataaataaatgttaatcattatagaccttactaataagaatatatactgaattgtccacatccagagtattacaccctgaacaagaaagacatgagagcctgacagtcatatatattatgacagctgtatatctgacaatatgaagtagaaactgaaaaaaaaaatcatcttagtgggaaacaaatacatgcttaaaattgttatatttactgtaaaactcctgataatcttagattg

SEQ ID NO: 15302 - DNA, 1885 bp, Homo sapiens
tgaataaaaggttgctgaagcaaaatactgcaatgaagttctgaaaatgaagagttaggactttacatgatttctcttgcctcattccctcaagaatgcacatatagacacacatatgccaatatcttttttatgtagttcaagtataactttgaataaaatgacttacattcaaggaaggtcaaaactattattctgaaacaaaatgtgacaattctagccattatgtgaattgtaagggtcagtaatccataaattatttggatggtaattgtatgttttattaatgtgatgtaattttgcactattgtattgtcatatttaatcaaactcttaaaaataccctgaaacataatgccaaatgtacagtttataggttcgtgttatttctgataagaatttaattgcattgtgctaatagttgtttattgctattaactttctgtgtatgtattattgcgatgcagacccaatagggttattttaagcacactaattagtcatctggatttttatagataaaatcacatgttgatcagaaatcatttttctacttatttttttgtagagtatttttccacacttgaaaaaaacatgattattttatatcaaacatcaacttttctttaaatcttattttagtagctaatgcatgtttgaaataagatgtgttagaaattatatgactatattaaggttgtgtttatattaggtgaaaaattgcatgcaattggtgaatcatgcagctttggggacatttacactgccactcacacacaggctctgtctcaatccgtatgcatgattcacgtcctttcaaaagtcccttttcaacatttggtaaagtgaaaatgttattcatagtgctaatgagccaataaacaatgctgcgtttcttttttctaactgcagcatattgtggtaaattttctcccaaaactttatttttggagttattgttggcaataaatacaacaaattatttgttggcaagtgatacaatttactgtataacaacttaatagtacaaagcatgaagatgtgaaaatatcatcttaaccagtttcattctatgaacataatattctggcagctttttctataactgagaatggtatatctttttatacactgcctaaatcagtactactgccagtcacctgaggtcaggtctgcacaacactaaattgggcaataacatagaacatctaggcagtcttgacagtcaaccagtgtaatcactaggggaagaaaaagtaggcctacccttttacttattaacttaagtaataaaaattgtataaaaatatgaatgttggctgcagaggagcctttacatgcagataatttgaagcagtctttgaaaataacaaaaattattccatttaatgaagggtttgttttgtttagcttttctcttttattcagaaaacatacctgtgcttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatagtgtatgtgtgtgacattcagctaacatt

SEQ ID NO: 15303 - DNA, 1187 bp, Homo sapiens
caggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcag

SEQ ID NO: 15304 - DNA, 1191 bp, Homo sapiens
atcttatgaaaggaatttttcagctccattataatcttatatagtggtctgcccttagctaaaatgtcattaaacagtacatgactgtaaatgaggaattatgttttcactgtttttcactcttgtagcatcctgagtttttcttcacagaacatacatcatggcataacccagtagttaccatgtatttagtgtgagtctccctgataaacttgtaagttacataagatcaggagatatatccagtttgtttcccattgtaagcagtgcttagtcagaagctggcttagagcaggtgcttagcaactgtttgttaagggaaggatggaaatgtatttaaagaagtgtgtaagtcaagttgaaaagtatatgccaaagatttatatagtatacatggatagcgtggtggaagactgagtatcagggaaagatggcaagtgaaggtaatttcagttggcacatgatgacgctgtcaacatttcttttgtctttatctggtggccactttgaatactaaaactgaagtcttatttcatagattttaaaattctaagtatttttagtatgacctttagaacctttttttcggaaccttcccaagttaaccataattattttgatcatagcagtgaatcaaggtcaaaacagatttgccgttttttttgaggatgagtcaacattgctcttcaccaatcctattttgaaatggtgtacgttagagcagaatgatctttatttcagtgatgtttcccttgtgttattttctggtttcccactcatgacaaaatttcatagttctatatttttctttgtgttcattattggaatttgctatggtaatgcattacatttacatagtgcaagaccaaaggactgaggatccatcctttgatttttttttttaagtgtgtgtgtgtatggttgactgttgtatatacaatcatgaggttatttgaggtatctgatggtgttgtgaaggtcttctgattctacgttctatgaaatttctattatatccttggaaacgaggtacctggttgatgggggagaggtagggtggtagggtagggagtctaacagatgtgtctgttacgccaagagattatgcttgaaccatctcagatagtcatgttatctgatgtgggaagaaagaggagaccgtggtatatatatgtatgtctttcacttgtt

SEQ ID NO: 15305 - DNA, 1723 bp, Homo sapiens
accccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccattcatcagtcctatactgcgttttattatatacaggagagcacttggtagcagtgatgtcagaaagtgcatggaatttagattcagaaaacagtttagatctcaggatcaccactagccatgccatctaacattttaaaagtaattactgtactagggtctgattgaagtgctttacgtgtattaacttgcttaatatttaccataggtacaaggataagtagccatattttagaagcatagag

SEQ ID NO: 15306 - DNA, 1127 bp, Homo sapiens
gagattgttatgagtattgaaacaaattttcttttaagagatacagatttttgtgaatgaaacaattttattaaagcattttttaatgttttacagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggtatggttttcagttgtatgctaatttatgatttgttttatataattacttatgtggattttatattaaagttatatatatgcatatatacaaatacacatgaaatccaaatgtagaggaaggatttagttttctactacatgggcataaatcagtacaggttgaatatatccgtgtactaaaatgctattatatgaaaagcttgggactagaagtgttttggattttggatttgtttagattttggaatatttgcatatgcataatgagatattttgaggaggggacccaagtctaaacataaaattcagttatgtttcacatacatcttatacacaggctgaatgtaattttatgcaacattttgaataattttgtgcatgaaacaaagttttgactgcaacccatcccatgaggccagatacaattttccacttgtagtgtcatgttggcactcaaaaagttttgaattttggggcattttggattttgaattttcagattagtgaggctcaacctgt

SEQ ID NO: 15307 - DNA, 1209 bp, Homo sapiens
attcttgtcaaaaaagtcaacataaatctgatgaaacctctagatatagccaccaatttacagaaaagggaagggaaaaaagattaagtaacactagagccatacaagcagctaaatttagaacatgggaaattttatacaaccaatgacctgatattaaaaacaagtggtataacaaaaacattgggaaacttaaagaataaaagagcccacagtgccatgcatatcactgaatgcaatgtatggatcttgtttgtatcctaatttggacaaatcaactgttaaaaacacatttgggggacaatccaaaatttggacacctcttgatgctctgtactttcatggaatttttattttagagaatcgtgttcatgtagtttttgtgattaagatgagtcagacttttgatgaaccaactaactgggatttgcagcttaccattttatttactaagagactaataattgttttctatcttttttttccccccttttagaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaaggtatatgcagtatcttctgtcatgagtgtgcactgatatctttggataggtgttactatttgtattttgttatgtttacttgggattagagtcttaattagttataatgttactaggtaatccattatatgcatttgattaaaagtgatagaaacaaacatcttcaagttgtacgttggtaggtaatagtttcaacatataaaacttttgtgttctttgagcccagcggttcacaagcactggtttttttggtttgttttgttttttaaatgagaactgaccacagtatagtagaaccagataactaatgttctcatttgggaactatgctgttttcatttctgataaaataaactttggtcacattagtccattgttttctctgtctcttttgagagttttgcttgttcaatgagtatacttttaaattgtctttcttttttctacttcctttgcctatattagctcttttcttagccttctttg

SEQ ID NO: 15308 - DNA, 1184 bp, Homo sapiens
gtactctgacaatcctttggttttagaaagaacaactcctataatcctataaaaagatttgaccaagtacttaagtatgaccaagcactctggatttgtgtacatcttaatcgttacatcatttttgccacttctttttggtttgggttccttttctggtttctgggtttccagtaccattcaattatgaaacacctgtaatttttaaataattgaattaaaagtcgagttatgtgacttctgttatctgaatgtgttaatggtgtttaaaacatgtttttggaagtatgtgttgtgttgatttagacctagtctgcatatgagaatgggtatgattgggtgacacatatttattttctttttagctgcaggttatatacagcacaatatcaagtgaaaatgtttatattgccagagcccatttaccttctcataacttcagtttattttttagggtgtcattctagaagaacaattacgaatgtatcttcactgttgtttgacactttgtgatttctgggagccaaacattgcaattgttaccattttatgggaatattatagtaagaacctggtgagtgaatagaataggaatttgctccaggaattttaaaaatttgtacatatttgaggaatgtctttatggtttaattatgaatagttatggatttttcttaaaaagttaatttttttcagagtagattggagtagctcgtgaatagttttatctttaacattgtagagctttgtcataagggaaacagcatttggtatcctttttctcttgagagcaagggtaaacaaagtagctaaaatgtatcagatatttataaaatcttcatttataaatgtttctaataataattgattgctcatgacacattgaacaggcactgctgtcctgagtaagaaacaatcctggcatttgagtagcttataggctactagtgggtgggtatacatacattgtgggaaaaaagttataattgtggaactccagaggagagggtatctaacccggtatctgtatttgtggaagacttcatgaggtcataatttttgaacttggctttgggaatgagtagaattttctaacagaagaaaaagggatccaggcagaatgaacaacatggacaaatacatggaggtatgaaaaagcatggtctgttcctaccatgttaaat

SEQ ID NO: 15309 - DNA, 1245 bp, Homo sapiens
gagatttgggctaggagagccaagatttacaattgcaaacaaaactgctttgcttctgaccaacataaggattgctcattatggggttaaagaggcacttcttaaaatacagcaacttctgagaaatccatgcactttacttgaaaaaaaaaaaacctctttttgaatatagcatttgcaaaacaatcttaaaagactgctgtagattcacaaagaggtaaagggaggagagtttttcagactgcttaccacttaagcaattgtgtagggcatatgtaactgggaatacgtgctgagataccctaagttagaaattcttattccatgggaaacttagttgttaatatcttattaaaaccattcttatttaaagggactgtttgatgcctaataagaatgtggtggagaagatatgaatggataagcctgtttgaggctgcagcatcatttgggaggactgtttgcctcccctctctctagcaagtgtgttttaaggccaactggtggcatttctgtgtgactagggagactcctggactgaaaatatgaatataatgaacaggtggactgcagacctgtctccacaaagcatgggttgtccttttcccaccacattttagtagaaaagaaatgtatttgaatttttttctatgaacaatctatcttactgtacagtaccaagtgtgatgtattttctctcaaaggatgattaagttatgagaatgtagattaatatatgtttttaattttatattacttggaatacaagtatgtggagaaccaactttgaaaatgaagttgtaaaataagtcattccatccaggtacctcttacaggggcatgaatggacattgctatctggagtcttgggcaattgcctgacagcatataactgggcatcaacattttgtaggtgttaatttgatttagagccctagaatatgcccctgctttactttcccaaggcgggttatgcaaacaaaataaccaagacaaagtcaccatagtgtgagtctttatccggaaggatttaattttatgtgcttcattcttaagctacccagatttgaaatgttctccaatttcatgaacaggtgctaattataggaaaaaactataagaagttaagggacattttggtcatctggcttcttgttcaagttctgtgtttcctttttgctggaaggtaacttgaagtatgtgatctttaatgttaacagatgcttttggttggacaacagaccc

SEQ ID NO: 15310 - DNA, 1144 bp, Homo sapiens
tttcctatccatttagtgtgctctcagcatttttaatatagaaagttgcatgaaactcttggaaattggaaggaaaatatttattaaatctactctttctgatttttttttttttcagatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagatattgcgtgatctaggagtgtaagttcctcaacctttgttgtataactagggtatgcatattcatttcatcgtacaaaaaaatacatatatatatatattctgcatgtatacatatacatatgtatatgctgtaatttgtttttgtttcaagatagggtctcactctgttgcccaggctggattgtggtggcgtgatcatggcttactgcagcctcaacctccagggctgaagcaatcttcacacctcagccttctgagtagctgggactacaggcatgcaccaccatgctttgctattttttatttttatttttatttttatttcttttgagatacagtcttgctctgttgtccccgagctggagcgcagtggcgctatctcatagctaggctcactgaaacctctgcctcccaagttcaatcgattctcctgccttagcctcacaagtagctgggattacaggcaccagccaccacgcccagctaatttttgtatttttagtagagacagggtttcgccatgttggccaggctggtcttaaactcctgacctcaggtgatccacccacctcagtcacccaaagtgctgggattacaggcatgagcc

SEQ ID NO: 15311 - DNA, 1147 bp, Homo sapiens
ctatagagaacttgaaatgtggctaggcatgtgctgtgggtataaattacatgctagatttcaaaaactttacttgaaaaagagaacagaatttttttaaatttattatgtgttgaaatgataatatttttggtatattgggttattttacctgtttctttttacttttttaatgtggttactaaaaaattttgaattacttacatggcttgcatcgtaattctattgaaaatggtgttctattgttacagtctggtagcttgacatttggtagtatgagaattttacatgaacattttcttagtgtttttgtctttttctgtttcagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgag

SEQ ID NO: 15312 - DNA, 3810 bp, Homo sapiens
attatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatgcatttgcttatgtcttagtccactcaggctgctataataaaataccatcaactatgtggtgtattaacaaaaatttatttctcacagttctgggagctgggaacttcaagatcaaggtgccagcagacttggggtctggtgagggcccacttctgttcataaagacagtgctttcttgctgtgtcctcacatgggaaaagtacaaggcatctctgtgggtccttttccatgcagcccattcatgagggttccatcctcatgacctaatcacttctcaaaggccctatctccaaataccatcacatttgggatttgtgaatgttgtaggggacgtaaaccttcagttcatagcagctttctcagctatattcaaaataccctacatattttagaaattctctatttcaaaacagtttatgggccactttacctcagatttcagtatctaccaaggacgatcatcttcctttcaggggtttcttaaaagg

SEQ ID NO: 15313 - DNA, 1175 bp, Homo sapiens
aaagtctccctcatagccctgttctacaaaagtcctatttccttccccacaaatagcctctgttacactgttgttagtttcttgtgtgaagatttacttttaaaatagaactattttttagtatatcttctagtgatcttagtttcagtaggcttaggaaatggatctgagagaaatggtatttaataactatgatatgtttaagaattattggcatttattttcaatgaggttacaagactcttttctttgaaaacactgtcaacttacagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcaggtaattatttttttaattacataattattgatctcctgatagtgtctagtgagttacaaatttcactgagaattttactgagaatcttgtccctatacttgtgttacttaggcagagattgtttcattcatatttgtacctgagcgcttacaatactgggcagaacagattttcaagtttttttatttaaataaagagcaggaagtatacaactctgccttgaaaatgcaaaccca

SEQ ID NO: 15314 - DNA, 1493 bp, Homo sapiens
aattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtatcgactagtgtcttgaatttatctttttgaatttgcctgatgttgttttttgagaattcttcttcctttagttaagtgttaaagccttttataggttgtcaagggggtaatttcaaatcattacaaacagattttaaatagaaaatttatttctgatggagcgtatcaaatgagctggaaagcgagactgtgtaaagtcagactgatgacatatataggtttcctgggcttaataagaaaaaaagctctcctcaggtctgaaggaattaatgttgggcttaggtaagacctatagtctttaagtgtttatttttaaaattaataccatgcctcatagttttgttttcagtctcttattgtggaagatttaaaacaacatatacaggagtaaagtaaggaacctccatgtacctatcatctagcttcagtagttatcaatttatggccaatttcatttcatctaaactcccacccactttccgtaagttgccatcccccatcttattttgaagcaaatcctagatatcatataattttatccataaatatttcagcatatattcctaagaaataatagctctttaaaaaaactaaaagtattattgtgcctcaaaaagaattagtaaaaataatatcagattttcagttatttcacaagtataaaaattgttaga

SEQ ID NO: 15315 - DNA, 1149 bp, Homo sapiens
atttcttccaaactattacgcatctctctggtatctgctacttgctggttctgcaagtagaatattgggatccatggccactttagataaaattctatttgaagatagcactttgctttttatttcaacaattaactacattcttcatacatatacagcctccttggtttgtttcacgtgttgtgtagctatcttctcccgccttaaaaaaaatttaaagtgtctatgattatagcagccagcagaaaattttcaggcaagaatattcattaaattcaactgactcctttctaagtgacatactcaaatgtaagcctaagggaagtataaagttgagcttttccaaaaaccataaggtgtatttcatgcctcacctattagaatattttagatattccatcttgcccataatatagcaatatgaaataatttaagaatctctactttaaaagtattctgtataaattttatattaccttaatacttcttatacatacattataattttatactaaaataatgttttatattaaaatatgtatgtacatgagaaatttggtaaataaacttggtcctttagttttccttaaagaactgtgcttaaggatatatttctcagtaaaagatcaggtaattcacctggagaaatataaaatagtaggatttctattttattttattttaagtttcgggatacatgtgcaggatgtgcaggtttgttacataggtaaacatgtgtcatggtggtttgctgcacctatcaacccattacctaggtattcagcccagaatgcattagctatttattctaatgttctccctcactccccacctcaaccaagccccacaggccccagtgtgtgtgattcacctccctgtgtccatgtgttctcattgttcagctcccacttataagtgtggtgtttgcttttctgttcctgcattagtttgctgaggacaatggctataaaataatttgatggcataatctatgaaatgctgaataattgtcttattgccacttcaagggattggtgataatataatagtatattgaatgcaaaataactagatatttccttctctctgaagacaagtgggtacaaacaattctctgtggtcataaatagacaaatatctgcttggtag

SEQ ID NO: 15316 - DNA, 2203 bp, Homo sapiens
ataaattatatattttcctctaagaattgaattaaatatgaaattagcgttccaagcaggtttactgccatggaatagctgaattcttaaggggaaaaaaagcgttaacatcggttgttttatttaaacgaccccctcccatgattttagtcaggcttgtgtgtaaggcacgcgtgtgcacatatatgactgcctttttttctaaatctatgattcacaaggtccctccattgtgtttaagtagaagcacgaaatcagcattctgatttatcctaaagaagcgttccaaattgtctttaagataacatgtttgagtttttcgtgttcattcataaattattttgatgtcagcatagatgaaatggcgattggttatctcttcctcttgccagccccttaaggatacgaggtgaaattagtagcaagaaagcatgtaattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggttaattttcttttctattgttttactgtgaatttctttcttcttttctcctccccctccccctctcccacccttcttagaccgtcccccccttccccttttaccccaatactgggcattacctcccaaccccccatcacgcagtggggctttctgcaaacctattgttatagatctccaaaaatgttttgtaccgcccacactgattcacaacttgaaaagctttcagggggctattgtttgaattgtgtgagtgtgattaagcgcagtttcagttagtgattccaagaaaacttttatacacctgccccctcccccattccaccccaactttaattgaaagttatgggggggaggggaatgcacattgcaaataacgctggattcagtgctgccccatgtgccttaactagtagctctaaaccatcttcacgatttctctttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatacaatatactttgtcgcctgtatctggtgaatgggtagaaaaatgaagaaacatgatcattttaaggttgaaaaaacaaagcgaaacagtttgctgtggaaagaaatgtatagattgccttattttagacacctctagtcacagtagctccctttattatttcatcgctgcctgtcctgtaatcattttgtagattcagatcaaaataatttgacttcatagtaaaa

SEQ ID NO: 15317 - DNA, 1174 bp, Homo sapiens
gacacagttctttaactctttttttttttaactcaacaatatgacatgcttatctttctacattagaacatgtagaactaataaaacttctcttaatggcttaataatgttatatggtgctattatattaataatttatttaatcagtttcccattgatagatgttcagatagatgtaattattttttaccaatcagtgctgtggtatctttttgagcctttgtgtatgtctgtagtagaattattaattgtggaattgctgggacaaagaatatgcacattttaatttttctaagtattgccaaattgccttaaaaatttttttctcccactgccagtattgcaaaaagaaactttaaaatggtatatgtttcactgaacttaagactttatacttttgtaatgcatgacagagtatctttcttttttaaaattatagagataatttataaagcaatgataattttaatctctctttttctcccccaccctcttctgctctttacagagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagataggtaatcatttttactttgttaatttatcagtttattgtgtttggaaaggatttctgaaaatgttttcatcttactgcatttcatattgtctagccaaaggaaaccaccatcatgtagaatatattaaatatcagaaatataggctatcttgcagtttgaattatctgcagaatgtactgaactgagccttcagcattaagcactgaatagttccttgaccaccttttccaccagactgttctgagaccccagttgaggagttgaagttcccaatagatagaggtgcccctttttacacccagaatttgccaaacacctcacctcttttttcaaatgaaaatgtacctattgttttgtctgtttttgaaagacagctcacgtatagaaagtccaaataatataaaaaccgtaaagaggaaaaaatcacttgaaatcctagaggtgggaattataatatatatggtattttgaaacttgtaat

SEQ ID NO: 15318 - DNA, 1199 bp, Homo sapiens
gaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatg

SEQ ID NO: 15319 - DNA, 1427 bp, Homo sapiens
cgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaatta

SEQ ID NO: 15320 - DNA, 1114 bp, Homo sapiens
tgccactgcactccacgctgggcgacagagtgagactctgtcaaaaaataaataaaaaataaaaatttggtttacagaggtatttgcagaactcctctatgttcttaaatgtttccctacttaatttaaaatctgacaaagtccattaaaatgttttattgaagtataatatgcacacataaatggacatatataaatgtacaacttgatgaattttctgatgaatttcactcaatattccagaatcctgactgtataaggaacatgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaagggataccagaacacacagttagcactccctctttcaaacagatgtttgtttaaaaataagtaaacaaataaacaacagtggataagacaagaatattttaagactttggaatgtactttgcagcatacatgactttcccaattctgctggactcttgatgattaatgccactttataggtccagcgatgagaagaacaggtgctacatatgacaggaaggaggctgtgatcaatactttaagctttactttgcataactgcgtatttaggaattaaaatataattgagatttgactaaacactgctaatgcgacgtctagaaaacatcaagaacaaaaaactgcacttactaaaaaataaatgatttttaaaatttaaaatgccagtggatttcagttgttttacagcaacagaatgctaaacttactgtcattactctgctgccacgtctggcagttttgaaagataatcatttcagcaggtttcatttattttgttacacagttttctaacaaatatatgtgtgtatgcaacaaactcaaatat

SEQ ID NO: 15321 - DNA, 1104 bp, Homo sapiens
atgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagcctt

SEQ ID NO: 15322 - DNA, 1239 bp, Homo sapiens
tgtgagattgtggccaaactggccaacccctttgagcttccggggttttgttgttgttgttgttgttgttttgtctgtaaaactggggagaaaagagggagaggggataatgtaggcctcatagggcggctgtgaagatgacgggacatggtgtactgaaagtggctagcacagcagctggcacacagtaggggctctcttactgttactactaataatacattcatcattttcaaaagttatgaatagatttttccttaactaaaagacatacacattacaataaagaaaataaaggaagtgacccttacctttaatgtctaaaactaaatttggcttcaacttgctgtaaatcctgccatcggacttcaagctccagaactggctgtcagcattctggtccagggccaggcctagcttggagccagatgttaccaggctgcccacaatcgtcaggcagcagtcttctgctatctgctcagtggaaaagaccagatatcttaaatatgtatccagctgtaagtctcatagcaattatttctctggttacattgggctttaaaattatcttagttcctagcttcatttaccccacatgaggcagttcagctcttagccaactagaatcggacaataaatatttatgccatttatttcagatgacacgaatgatgggaaaatctcaatgtttgtgcatcgtcagagacttctgccctttgcaagactatcttactagtagggaaagcctcataacattagaactgcccatcatatttttccctgtcataagtgaccatgatcccaggcaggttctgtagctatatctccctctgacatctccacctctgcttggcctgaccttccagtatatgactgcacctctaattttgtagcactgggtggctaaagggcattttatcattttaaaactcggaattgcatttattagcatttgtctttccttcatgagaattaaaattttctaaacaggcatgctttccagctatgaaaacagaaaaatgcagactcactagagggtgttttaatgcaaagattttatgagcccttccctgaagtgaatctacccttaatatataaataatgtatggcagtcatgttcacatgccattaacaaaaattactggccaggtacagtggctcacaactgtaatcccaactctttgggaggccaaggtgagaggatcacttgtgagaccctatctctacagaaaagtttta

SEQ ID NO: 15323 - DNA, 1186 bp, Homo sapiens
cttagaaggagagagtgtaggaacagccatatgttctgataaggtaaatacagtgcaatagttgtcattatttttgagacagtgtgttgctctgtcatccaggctgagatgcagtgacatgatcacagctcactgcaacctcaacctcctgggctcaatgatcctctcaccccaaactcctgagtaggtagaactacaggcacatgccaccatgcccagctaattttttcacgtttttgtagcgatggggtcttgctgtgttgcctgggctggtctcaaattcctggcctcaagcaaccttcctgcctcagcctcccaaagtgctgggattttgtagtctcaaattagaattggaagtatcaatatgaactcaagagatattttgtgtatgtgtgtatgtaaagccatcacttgaaatatcatttctcactgaaacaaggcagggcttcttagagaagtagctgatttcagatctagagcacaaatataaagaattaacctggagtatattaaatagcaaggaagatatcaaagactagtcaggtcatgtcaaaagactcaagagctaacttgaagaaatgcccaaagatgtaacagtttgagcttcagtaataataatgaccattacaatgggttgaaaccttttaaatatatttaaatccatgagttcatgatacttttttcaaaagaggtcacttttggaatttgatagggaaccaatttattatcttataaactgataaagaaaaacagttaagcatttgtcttgcctttcctacattaactgtataattgagcagacaaaataatatgtgaggggcagtgatatgaggggcagtgttattttgtgaaagtattcaggctggacgcgttggctcatgcctgtaatctcagcactttgggatgccaaggcgggcagatcacctcaggtcaagggttccagaccagcctggccaacatggcgaaaccccttctctaataaaaatacaagaattagccgggcgtggtggtgggcacctgtaatctcagctactcgggaggctgaggcaggagaattgcttgaacctaggaggcagaggttgcagtgggcagagatcacgccactgcactctagcctgggacagagcgagactgtcccccacaaaaaaaaaaaaaaagaaagaaagtattccaactacttaaataa

SEQ ID NO: 15324 - DNA, 1059 bp, Homo sapiens
agcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaacatggtctcgtaacatgttattttcttagagcactggtctctcagaatatgtcttggtctatttgtctttgtgcgtggcctcctcacccacctcccagggaagaacgtgaatattccgggggatttcagcttctggggcttccatactctacgtgtcaggggtacagctcataggatttcagtttggccacagctgaatgaatgagaaattgccagataaatcctccaaaccatttctccacaaaccacttcctggccatgtagtgggaggcttgtttgaccttttttaacctttcctggtcaggtgccaggccagtcctgcaaagccagcagagtttcattttcatttaaccgcctttttttttttcactttggatcaaatgggttttagtttcccgccgccccaaccctgctagagtgcagtggtataatcatggctcactgcagcctcgacttcc

SEQ ID NO: 15325 - DNA, 1049 bp, Homo sapiens
gtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaa

SEQ ID NO: 15326 - DNA, 1276 bp, Homo sapiens
cacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagag

SEQ ID NO: 15327 - DNA, 1264 bp, Homo sapiens
gtggaataggcatcatctgtatctcaccaaggaggcagatgaagcttagatactgtgcccgaagcagagctggtacgtggggaagccgtattcaactcaggcctgttggacacagcccaagctctcccgtctatccaagcgggcatcaaacaggccaaaattcagttgagtttatcaacttcttatggagaggaagaggagagatgagcatttattgagcacctaacttgtacactgctccttccagggactagggagatacaaaggtaaatgatggcgtgcccccatctggtgggagtgcaaactccaggaggaaggaagcgggggccaggagagtggatctcgtaagatgaataattgctcacatttgtatgcaggctgtcttctaagtgtttttcggtagtatttatttggatctgggtccataggacaattatcgtcttcattttattgatgaggaaaccaagacagagacattaaagtaacttgcccaagattttaccaaattagcagagttgagatgcaaatccaggctgtctgactccagagctgcattttttaaaaaaccactgtaggagaataggctaattagtttctttattaccctacatactaaaattgttttacccacctcagtgggtaaaacaaccctcagttgtcataggggaaagtttcttaaaaaacaaacaaaaactgagtctacctcctaacttctctaagtgttcagacagttgaattcttgtttctgcagcaccaacaagcctaaattaccaacccattactccacagtgggaaatacaaacgtggagcacagcacttgctgtggtgtgtccagtccctggtctctaagttgggcccctagcatagccaggagattgcttgggaagcacagaccagagcaaggagacttgtcagttgaggaagaaaggtttctcagccaccatcgttcgaggtttccttttcctctgatggctttgccagtagaggaagaatactaaaaatgagttcaccattccttcttgattttacatctacaagttctgctgcctgaagacagatggcctcagccttctcacagtcacctcaattgaaaatgcccctgatttcttcacgagagtaatttaatctggttgacaaagctgtgagtaatgggaagatgtgtgacaaaaaaagtgacggccttcagaaagtcagaaagcattgggaattgtcactttaaacacattctaatatcactcattcaggtgaggctgaaaagaagaag

SEQ ID NO: 15328 - DNA, 1196 bp, Homo sapiens
ttaagtttagttgaagattttaaaaggttgtaaacttcctttgatcttcaacttttaagactccaaatgccagttctgcagcttctgtaagctggaaaaaatatccccccgaataataaggaaaacaatgtataaacattttccgaactattctatccacaaagaattccatttataaatggaatactcccttctttgtctttgcctaggagcttgagggatagctgtttgtatttgtacattttctgaatttctacagtttacacttgtttatggtacattggggagttcagagtaaccatttgcaaatgtttgaagatattcaaaagaaaatattccccctcctcagttttccagggaaatgacatagactctttaagtaaaataatcaatggaaaaaatgtgtacaaggagtaaccctttcatctcacttttccacctttgtggctcccaaatttctaagtttcaaaaaccagaaagaaaatataagaccctttttcctggtcccaattccatgatactactccaggctcagcaggggggacttgacatcttattttctcagggaaagctggaggaggcacctgtagtttggctttttggagtttaattattagtctggtcatggagccacagtcctagaaacaactgttccaaggcaaggagttcacttcattggggaagccaaaagggtggaggtcccaaaaagttttttgccaatttagtttctcaaactgagaagttcaagagaggaggctgtctgggaggaggttgggaagtcagtccatacattcgaaacaatactataggtgcctacttttaaaacaaggaaaagaaggaaaactgagagtgacaaaaggaaatcagtatgaatgggatgtgctcggatcctgtgtcagacttgtgctatctaatggtccagtacttgactattgggaatattaattggtgacagtccctaagttaagggttagcttgtctgttgggatgcagttggcacatatagttctaggtagaggtacttcagagagccagaaagaagacaccaggtctgtgtcatggacacatgtgagtgggaggacctgggagtgtgcttcctgtgatcatttcagacttgtagaggaaagttttctggaatgaatggtgtcaagattggcctgagatatgtcccaattcaatgctgctgggaccatgtt

SEQ ID NO: 15329 - DNA, 1141 bp, Homo sapiens
tctctggttttaagattctggagaggatgataacctagtaacaccacagtgcttaaaaaaaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcgtggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgc

SEQ ID NO: 15330 - DNA, 1919 bp, Homo sapiens
ttctttgtaattgctgtggtcaaagaaaaccttttgtttaccaagatttcttccattatttctccccaaatttctgatgtctacatttaattcttctttctagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactcttgaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgaatggtttttttggttctaaatttaagatgtaatatttcctataaaagggtgaaagcagtttctttctctataacctcaatcaccagtttagtgagagcctttcttggcaggcaggaggcagtgtcactgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtg

SEQ ID NO: 15331 - DNA, 1118 bp, Homo sapiens
gggatcaggtcttgctgtgttgcccatgctggtttgaactcctggcctcaagcagtcttcctgcctctgccttccaaagtgctaagattacatgcatgagtcgctgtgactggccccaaaattatacttttctataaactacctgtttccttaaataaaatatgattgatgtttttgaaagcagaaccatcttagcctttgtgttattgggctttgcaaatagaaatacttttatttgacaaattatgaagaatgaataaaataactaacaatagacagactagccagatattaaactctttagtctgactcccacatctttataagtaggaatgtttataattttaaaaaattgtatatgaatagtgaaattgtcatcgagtcagtttagttaaattgacaataagttaacttcagggattcagattgatatgttctcattgagatatgcagaatctttgtgtttgcctttcccttttaggaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagtaagccttataggtttaaataatttaaataattggaattatatctctgatgatagctttgggttttgttgttgttgttcatttgtttgcttgctcgcttgctttctttaaataatatctgtatattttataattttattactttgaagaacgtttttaaggaatggtagtcaaggttatacagaaaaatgatttctaacaaggattggaaatcctcgttttcttaaatattaaattgttaggtagagtaggacctgggtttgaggttaggtcagttggtctcataaggggattttcagtgttggggatatctctgggaatatgagtaaggaaaggtgtttgtgaaatgcatagtgcttacttggaaggctgtgtcacaagctccagttcatgtttactgtagagaaacagtactgtggaccctgatgtcaagaggttggttaagggaaaagctaacatttatagaataccaccttgt

SEQ ID NO: 15332 - DNA, 2139 bp, Homo sapiens
tgtgactgacacagacccttgatgaactcagctgctgcttcctcgtttataactacagagcccttttgggtgacaccatttctcctccaggtctgtccaggtttctgtcatctcttgccttaccatagatattttcagtccttaatggtcacctacaaaatattcattgatgtggccaggtgcggtggctcacacctgtaatcccagcactttgggaggccaaggtgggcggatcacgaagtcaggagatcaagaccatcctggcagtggcgggcgcctgtagtcccagctactcgggaggctgaggcaggagaatggcgtgaacctgggaggcaaagcttgcagtgaaccgagattgcaccactgcactccagcctgggctacagagtgagactccatctcaaaaaaaaaaaaaaaaatcattgatgaaaagtggctgtgctctaccggcgggatttgactgcgtgatgtctcacagaaagttttctgctcccagacatgggtccctcggcttcctgcctcagaagcgcagcagcaggcatcgtgggaaggtgaagagcttccctaaggatgatccgtccaagccggtccacctcacagccttcctgggatacaaagctggcatgacccacatcatgagggaagtcgacagcccagcatccaaggtgaacaagaagcaggtggtggaggctgtgaccattgtggagacgccacccatggtggttgtgggcattgtgggctatgtggaaaccccttgaggcctccggaccttcaagactgtcttcgctgagcacatcagtaatgaatgcaagaggcgtttctataagaactggcataaatctaaaaagaaggcctttacgaagtactgcaagaaatggcaggatgaggatgtcaagaagcagctggagaaggacttcagcagcatgaagaaatactgccacgtcatccgcgtcattgcccacacccagatgcgcctgcttcctctgcgccagaagaaggcccacctgatggagatccaggtgaacggaggcaccgtggctgagaagctggactgggtctgcgagaggctcgagcagcaggtaaatgtgaaccaagtgtttgggcaggatgagatgatcgacgtcattggggtgaccaagggcaaaggctacaaaggggtcaccagtcgttggcacaccaagaagctgccctgcaagacccaccgaggcctgtgcaaggtggcctgtattggggcatggcatcctgctcgtgtggccttctctgtggcacgtgctggggagaaaggctaccgtcaccgcactgagatcaacaagaagatctataagattggccagggctaccttatcaaggatggcaagctgatcaagaacaatgcctccactgactctgacctgtctgacaagagcaccaatcctctgggtggctttgtccactatggtgaagtgaccaatgaccttgtcatgctgaaaggctgtgtggtgggaaccaagaagcgggtgctcaccctccacgagtccttgctggtgcagatgaaacggcaggctctggagaagattgaccttaagttcattgacaccacctccaagtttggccatggctgcttccagaccatggagcagaagaaagcattcatgggaccactcaagaaagacggaattgcaaaggaagaaggagcttaatgccaggaacagatttcgcagctggtgtggtctcaataaaagttattttccactgggaaaaaaaaagaaaagtggctgtgtcttccaagcgatgtgactccacaatacatgggcagcagtgaacattggttttcccgtggcgccagactcttcctctgcctcagggaagcagctctgcttgaagcccctgtggatatggtttccatgatttttcttccagatatcactacttggaaaattgtggttttattcctactcattaagtcttataaacattatgatttgacatgtcacattccccagtgaatttccgctttgtaaactctgggctgtttagtcagttgcagaaactaggtagggaggctgggggtggcaggaatgtagactatcaccccctgtccctgtcccttcccacacagacaatccagccaatggcagaagactgccggaaatgtagaag

SEQ ID NO: 15333 - DNA, 1308 bp, Homo sapiens
ctactcagggggctgaggcacgaaatcacttgaacccaggagacggaggttgccatgagccaagatcagccactgcactccagcctgtgcaacagagcaagactccatctcaaaaaaaaaaaaattatacatgcttctcaactttaaaatatgtgttttgaactcccccaccttgtataaaatattggactaaatttatattttttattctcagggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaataccatttctcctatttttcagaagttttttcctagtcaactgagtgacttgtttaaacaa

SEQ ID NO: 15334 - DNA, 1517 bp, Homo sapiens
gccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcaggtcagtgccgaatgctatggcataaaaataacaatatggggatgaggggggatctctgggggagcctgtcttctctttactttgaactttattccacactgaaaaccatggagcagtggtgcacataatatggctcccagccagttccatctcagggttttacctgcaaaccaaatagggctgtcaggtgccccccttcccccgcacagtttgctgatagttcagaaatctactgctcgtgaagagaacacgtacgcattca

SEQ ID NO: 15335 - DNA, 1108 bp, Homo sapiens
ggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctc

SEQ ID NO: 15336 - DNA, 2308 bp, Homo sapiens
ggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctatcttactccaagaagtctctttgttctccctccccctttcttgaaccctag

SEQ ID NO: 15337 - DNA, 1478 bp, Homo sapiens
caaagttatcctggctcagagtattctctagttgtcacatatgtgctttttttcactaataggagcagtaagctccttgaaagtaagagcttttttctcattatatttctacctgacaagcacagtgttaggcatgtaatagatgttcaataaattaaaaacttaatgaattgaattttttaatgttcaattttaactttttaacgttaaaccatcaattcaacctatctattttggaatatatttttagtatatttttgactaaaatgttagatttttttttctctccaggtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtacaactc

SEQ ID NO: 15338 - DNA, 2659 bp, Homo sapiens
aaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatcaatagaaattatgctgtagttttccaataatttttgagaggaatactatcttggttttataatctgaaagctagtttgtgactttctgcctttttagttcatattgcatataaagtaaaaaccaagaactatttggtataaattactatcaagccacatgctgtgactttgaagtgtggttcttgttattttgtgggcaaaattatgttctattttatatcagtggacttgaactaagaatttactcctctgtaagcct

SEQ ID NO: 15339 - DNA, 1190 bp, Homo sapiens
agaaaaaaagaaggggtcctgccgaagatataaggaagctccctggggatcccgcagcacagcacaaacttagttcttgagagccgcacaaaaccaacttccgccccagtggagttgcgtccggaaggcgcggccccggaggtcacgtgggcccgcggaattacagcctggcggggcgctcaggtggaagcagtaggccacattatgtcgactgttccatgcaagtcagggtgggggccgtccctatcgcaggcatgagacaagtccagctgcgtcgtgtctggtaatctgagggcaagaagaacgatttgcagaagctcccagttttcttggctgtggcacagtcgctttgagggccaggttccttcggcttcctcccgactcccctgcttccccccgtaggattcccgttggtatcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccaggtgggcgcgggccctgtgggcttcccgccctcccctgcccagccgagccgcactgcctcctcgccgtgcgggcggggcccgggttcgggccacggtcgggcgggcgggccgcgctcggggtgcggcggcgactccggcaacatggcggccagcctggagtccactcgtggccgggccgggtggggagcgcgctggggggaagcggacgcgcggttcccagtggctgcggggctggggcccccctcgaagtgttgcaagtcgaggtgccttttaaaagtgcatcgtaattcctagcctcacttggggtcggaaatggggacgtggcttccttccgcgggggcagcggtggggttgaggatggggccgggcgtcgcgcctctgaggttggcggtggggccgagctgcctctccctgccact

SEQ ID NO: 15340 - DNA, 1286 bp, Homo sapiens
tggagtggcacggggcttcctggcagcctttgatgcagcctggatggtgaagcggtgggcagagggcgctgagtccctagaggtgttggctgagcggtaagacctgagttgaggaggatgtgggcagggcaggacatgtgacaaggttcaggaagaggggcaggggtgctgagtgaatagacggaggaataggcagaagaaaaggcctggcagttcctgagaggtgggtgctgacaggtgccctcccattcatgcccctgccccttaccctcaccccctcagtgagagcctgtaccagcttctgtcacagacatccccagaaaacatgcatcgcaatgtggcccagtatgggctggacccagccacccgctaccccaacctgaacctccgggcagtgacccccaatcaggtcagacccccgacacacccaccagccttcccaagccaacccccttcccccaggtcaggccctccctgcccagtcgctgccctttggggtcaatcctacccccggcaggcccttacccctggactcaggggctgtgtggccagcctgccttgagacctgagcggggctgccttaggtacgagacctgtatgatgtgctagccaaggagcctgtgcagaggaacaacgacaagacagatacagggatgccagccaccggtgagcaggccttcctcccaaggggtgaccaaaatatgtactacccagcgaggcccaggtggtccctgcaaagcagctgcagcctcaggacaggagcagcgtgccggagcactcattgttggctggtgggttggttgggggcctgctggaggaacggaggggcagcaccgcacaggcagcagttggctgccagtctgaatgtaagcgcgttagtgtttgaaccaccgttacagccatagtggtgctggcaacctcccctgcccccagtttagtctgctgccctctatgtggccagttgcgatttcactttattcactcctctactttattccaaagagattttttttaaaagagaattgggatggagagctgctgatagtcagctttaggctggtgccctagtagaggtgggtccctgactcctcctcccctacagaacccccacatgcagcagctgggctccctatatgcctgggatgggcagagggggccttgggcacagcacagccttctttcccagggtcggcaggcacccaggaggagctgctacgctggtgccaggagcagacagctgggtacccgggagtccacgtctccgatttgtcttcctcctgggctga

SEQ ID NO: 15341 - DNA, 1209 bp, Homo sapiens
tatctatctatatatattatatagatatatatttgccaaattgcctttcagaaaggatgtaaacagttaatgttccccttggcagagtatgggagtgcctattttgaaatgtatttgccaacttaacagacagaaaatggtatgttgttctaatttgcagtatttgataactagcgaagttggatttttatatatccattggctgtttctgtttcttttgaaaattgtgtgtacctgtttttctattaggggttaatctgtgtctttcctacatttagttggtatttatttcaatgtctgatgtgaggtaggggtctaacatcattgtcccttccacccccaccccaatactattgtactgtttattgaataatacttcctttcattgctgatttcagaggacactgtatcataaacttaatattagaataagagctatttcagttcaaaaatgaatttttttctctaattaaaaagaattgttatatttaaacctgatctatttaaatgtagtcagtagtaaaattggctaatgtttaacctgtttgaatggtatttggtgcatattctttcttcccttcaagcacaattaaacataaaagtggctaatcatttcgccctcttgttatccacaaccacagagagcctaccagttttaaacccttgttcatatccagagtaccaccatcttcctggaggtgattgttttatttgcagtcagaagtagccaggagaagatccttgggctcattagggctggccttatatctcaagcttagtaagtgaccgtaaacatcatacatgtattttcagttgcagcagcagtacttccaaaaaggcttctttatgatcctttgaaagaatattctttttttggctatgtttctcacatcttacattttaccatacttgctaaaaattaaaggtaactgctgttaaaggatgaaagaaactcctagaaaatgtggctgaaaagtgcaaagcttctctagattatattaagatattttgaggtactacgtagaatgaactattaagtgctattaaggctatttaagaagcagaaagaatgtaattgccataagagcatcatgtttacttttgtattatgtaaagagggtacaaattggggcagtaatgtatgcattatttaatgcttgatgttttctctcaacaagtgcaaagaaagtccccaaatgtgctcagcat

SEQ ID NO: 15342 - DNA, 1179 bp, Homo sapiens
ggcgtgagccaccgcgcccggcttcttgcagctgttattaagttctgtgttgcttcaggaatatttaaaatatttggaaggtctcagaatttgtatgtttctcaaatttattcttatcaatgcatattattggaataaccaacttaatacttgagcttactgtccctataaatggagcactgctaatttttacattaaatttattattaataaaatattatttacatgaatttttgctgacaaaaaatttgaaactttatttgttgagagatgggtataaatacctatatttatatttattgatgacagttaaccataggtaaatatggttgattttctgaaattttgtattactttaaagtgttgaagctatttagatacagcttgggaacagccataactcaattttccactgcagaaattagctatgtattaaaagcataatttaaaccccttgctcaccttgagttacatcacaaaggcaggtggtttgagagtttatatgtgggaataaaaggaagctggtattacatccccattttctaaaaaaggaaattgaggtgcagagataatgtcttggctaagattattcagttagatgattcagtgagaatcagctctaagcctaccactgaaaataaaattgtatctaagtagataatatggcttactcagttgatttaggtctcctttttctgtttgtttgtttttcctctagaatgtcaaaattctgaaaactattttttggtgtcaggggaagagggaattgatactgtgcataaacaatttttataaatactgtaagataaatttcagtgggtttttaaaaaaactttctagtgtcacccacctgtacaggttattttgctgacagttaaagcagcattacagttctcaaaagaaatgaacagtttacccagaggcagcaacaggacaagagcacagagctcaggctcacgtagagctgagttggaatttctgcaagtgtatgtggcctgcgacccattaacctctcaacctcattttctcacctataaaatggagatgattatacatacctcacagggtcattgaggcttaaatgggaaaatatatggaaagtacttaatactgggtctgacacagaataaaccctgtactgaagtagccaggctctggaaagcctgcctccagttaata

SEQ ID NO: 15343 - DNA, 1649 bp, Homo sapiens
cctgaaagctttctacttacttcctcaaagcttcatacacttgccagttttttttttttttttttttttttttttttttttttttttgagacggagtctcgctctgtcgcccaggcgggactgtggactgcagtggcgcaatctcggctcactgcaagctccgcttccggggttcacgccattctcctgcctcagcctcccgacacttgccagtttttagaaaactctggcagtgattgtacacctgatttaagaagtttaaagttctgtacaaataatcagtactatgtggcattcttcccaaaaaatggatcaacattttttacttgctgaagatataaagttggataaaagtaagctgtttgaaagtttttctttagcactgtaatgatacaataattggtagtttctgtaacactttcttgacctttaaaaaagctaatgaaaaacaaatggtaaacttttccatagtcttcaaagaaaatacttttaagtagttaaaaaaatggaaaggaaataaggaaatctgttcttttggtttcagtccttttttttttttttttttttttttttgagacagtctctctctgtcacccaggctggagtgcaatggcatgatctcggctcactgcaacctccgcctcatgggttcaagcaattctcctgcctcagcctcctgagtagctcggactacaggtgcatgccaccatgcccagctaattttttgtgtttttagtagagatggggtttcaccgtgttagccaggatggtctcgatctcctgacctcatgatccgcctgcctcggcctcccaaagtgctgggattacaggcatgagccactgcgcgtggcctggaaatcagttcttcagacctgccctgtaacctcccatgggcaaattagaacaaaactacaaaaccgtatccttgaaggaaagacagatccatgcagtccaagcaggcttccagcagatatgcactccagaaagctgctgggtatcctctctgcctgctgagttggcccaggccatttcctctggctcttagctcaaagcctgccttagtgctgttcaagtctgagaagtgctgttcaagacctttcagaagaggtcatatggccgttgtgctcatcagtgggtctccccaaccttggttgaaagtgttcctctttgaagtggctagagtacttggtggggggattcttgtggtccagaggaaacctagtctgtggccggctcttagcagtgtccctgcttcaggaggtggatccccagcctgatcctgccctttccacgtcacttgtctcactgccagcaccatcctgcatgcttccccccatgcttcctgcattccacgcattagatatttgtcacccttagatgtgtgaggctctgcaagatcatcttcctggcttcaggaacatttctgttcaagttctgcaccatgtttaaattaatagaagttcaatggcatgcacatttgatttcattcttttatccatggttatgacttacattttaagtagaatcccttttcctacttttaacaagcccactttaaaatcaggcaaagtcttatgttacatacagtactcttaggtgtttttctgaaataagcatactactgaaatttgaaagcttacaccattttg

SEQ ID NO: 15344 - DNA, 1099 bp, Homo sapiens
cagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtaattttctcagctccatgaaaagcattgctatagtagcattggaaactttctaaatatttaagacaaaaatgtgttccttatctataaaattttaggtgatcatgtttgtgtacaaatggcctttagaaagtaaagctatatccaacttatatttaaaattattttccagaaaatatatcacatttgaccattttattttcatgctttgtaggtatccttaaaatgtttattgagtgaatgagaaatttaatatatcagacttaaatgttatagaacatttaattaaaaccctttatattatgcttaatgtgtatattaactcctttaaaaatggtattttcttcaatgttaaggctgttcattttgggtatccatgacacttgctctaccagatgcctttagaggagtgagtttcctcccttagtaacaaaggaaagacttctcatattcattcatttattgtcattatttcctaagcaatgactataggccaggcac

SEQ ID NO: 15345 - DNA, 1239 bp, Homo sapiens
acttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgaga

SEQ ID NO: 15346 - DNA, 1276 bp, Homo sapiens
tcctaaacaaagccactggactgatctcaaattttagatacagttgtgtcactattctgctccagaacttttccaggtagaccgagaaccatacagtaaaatttggggaggaagattggacagtccaccttggtgtccctaaggatgagcagggcagtgcggtcagtcatactcccttaccacattatgtacttgttttgttggtatttttttttttaaggtggagtttcgctcttgttgcttaggctgcagtgcaatggcgtgatctcagctcactgcatcctccgcctcccgggttcaagtgattctcctgcctcagccttcccaagtagctgggattacaggcatgcgccaccacgcctggctaatttttgtatttttagtagagacagggtttctctgtgttggtcaggctggtctcgaactcctgccctcaggtgatccacccgcctcggcctcccaaagtgctgggattacaggcatgggccactgtgcctggccctataatggctagtttttaaaattactttcttttaaactagttttttttttttttttaagaatgttggtatgttttccagtcttagcttgtgcagtaaatgattactatcaattgtagaccacatataaaagatatattcagtattattggattttgttaatcatttttttctagataacgggaagagaatattctacacttgatcttagccaaaaggccgagaagcgatgagaatattctaatactcagcaagggaagaaacatcacaatttgtattaacaatttagctagctagcatttaagcctgtgggcatggctttgttcatataatttctgtgagacttatttaagagctgaagtataaaaaggcctttaattgtcatttgtgaaaatcaggagtgattagtgtaagtttgttttatttagaacttttggtggtggacacaagagaaaatccgtatgtaattttattgcatttactttgttggtattttgtaggtcaggaacctagcattgtttagactaaaaaatatccaattttagagatggggttaactttttcccctaatatatttattattgttaatactgctgtttaacactcattccaaaacttagtggcatgaaacactttttattatgcacatcgattctgcaagttgtgccctctgaaagggcacagtggggatagatttttctcagccatgtggtgactgggatctcagttgggaagactggaaagttgagattgacacacttgactcctgggggcca

SEQ ID NO: 15347 - DNA, 1614 bp, Homo sapiens
ccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaacttttctgttg

SEQ ID NO: 15348 - DNA, 1690 bp, Homo sapiens
tgtagattttaataggattccattgtaaatgaaagttaatcttaggaattaaatgaatccttagggaaatttgtactctatctttacaaaataatatcctttagaaatgtctcaacatagggtagtctaggcttccaagagattaaaattaatgaaagtttctgtaatgtatgtctgccagtaatctgtggtagtctagaaagtagggattataaaaatttgttgtttgcatacacgcataaaaactttcctattattttttgtatttctcttatgctttcagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatatagcagtgtgacttcatcttttttataagcctgtattggttacatctttcttaccctacccttttctgagttttaatgaagtaaattatttaacatatttttatatcctgtttgatattgcaatttccttaccaaaacttcttcagggttaaaacaaaaaaaaaaataaaaaaagggcagcaaaaatgggaaaatttaatttagcactcatccttttagagagttttaagagtgtacttgtttgttagtagatcttcagtgttcattttcattttgatataat

SEQ ID NO: 15349 - DNA, 1190 bp, Homo sapiens
gttctcattcttaggggataaaatacatctttttcctgcccctggaggcagggtctcactctgtcgcccagactggaaagcagtggtgcaatcacagctcactgcagccttgacctcccaggctcaagcgaacctcccacatcagcctcccaagtagctgggataacaggtgtgcaccattatggtggctaatttttttgtggagatgggggtctcgctatgttgcccaagctggtctcaaactcctgggctcaggtgatccttggcctcccaaagtgctggaattacaggcatgagccaccactcccacctaaaatacatcttaagctagttgatatctgccaactcattattttccaggtaacagtgatttacagagtaatttttaaactcttgtaggatatctacacttggtgtcaactaagcaaaatgtatatatattattctcaaagaaatagtaattctgttttgaaattgtcttttgtagttttttcattgttttattattgtttaattctgacttaatttgtgagaaagatggcttccataacagtatttgggtgtggtttttttctttgaattcgaataggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaagggtaagcttaccaaatagtacatgtgctctaactatggagagatttcactccaaattttcagtagaactaaaggttttatgtgctattgatatgggagtgctgggaagggaagagtgtggtcccgtaaaatgatacggaaagcgggaggggaagtgctgggtagagaaaggtgggtccctggctagggctccacccccacagatctaggtgaggataggcactcctgctttcatgcccaaatgttaccattttccaagaccaccttggcctgccatgccccaatcctgggcctataaaaacccgagaccctagtgggcagacacacgagcggctggacattgtgaggaacacttc

SEQ ID NO: 15350 - DNA, 1340 bp, Homo sapiens
ctggctttgttaaactacagatactggagaatataggaagaagctatgaataatatccagggacatagtatttgaatgataaattcattgtttttattcatatgtggtaataatggaaaatttattttaagattaggagaggaaaggaatctgaaaagtttgtgtcatctccttgaaggacagaaggcttcatggggcattaaaataaaacaaaaaataccttctctccctaagattaatggtaccttccaaaggaaattaagtagtagtcatatacctgtgaggaaaagcatattgagactaaagatagaatgtacctgcacaatatagagggggcagggaagatagacatggacatttttgagactccaaaagggactttatctaggatatggagttaaatattttggtaattgctctttgaaacaaaacagttgttctaaaatatgttattatagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcc

SEQ ID NO: 15351 - DNA, 1122 bp, Homo sapiens
agcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaag

SEQ ID NO: 15352 - DNA, 2076 bp, Homo sapiens
aattttaaagtattccctatctcagcagtagttgagggcaggaagaatggtgaatatcgtttgcccatttctcagtgtgctcaccttcccttttattgcatgttctcccttgttttttgaatactgaaaaagatgtctctaggcaactgatttcatatgtgtatggttttttatgcattcctctgaggtttttatattatcctatcccattctgccccgggtataaccatatgctaaaacgttttatattccttttatataaaatataatgaaccaaaatacgtagaatttacttcaaaaggatctagggtagtcagtataatatgttttgtatttttctcatcctatttttcattatatatacatataaagtatcaattttgtcagaataattgtgaattaatatatcaggttttctgggtacaagctaaatgtaagataattgtataagtaagaaaaatgttagaaagtttgctctcacataattattatgttttttatatcctttaattgcagctctttaatattggaaggtgttgaaccacagagtacatgtgaattagaagtggatgctgtagctgctgatatcttaaatcgtctggacattgaaggttcatacacaattattcttaatatatgtttttattttttaaaattaatgaccggcgggtgtggtggctcacgcctgtaatcccagcactttgggaggccaaggtgggtggatcatgaggtcagatcgagaccatcctggccaacatggtgaaaccccgtctctactaaaatacaaaataaattagctgagtgtggtggcacacgtctgtagtcccagctacttgggaggctgaggcaggggaatcacttgagcctgggtggcggaggttgcagtgggccaagatcgcaccactgcactccagcctggtgatagagcaagactctatctcaaaaaaaaaaaaaaaaaaaaaaaaaaaattaatgaccaaaatggaatagaaaaagtaggaaagaaaactttacgaggaaactaagatattatagaaggaggatacaaaatgttatgaagattgcttctatacttctgatgaggtattaattttttgtttatatttttgtccaaatgactatatttgaatagatgatactaaaataagtgtgacactaaataaaattagctaatataaagcaatttaatgtactgtgccttttaatttcttaattttcatattatatatcagcaaagggactcttaggtctattgactatcatcagatgtttgaattgtattcacttgctggattttggggaaccactaggaagaaaactaaaaaaggagtaacatagtaagtgtaggttgggataatttgtccactttattacacaaaatatgtgattggtttttttaaaggcagtatttgttaaagaaaagtttagattttttaggcatttcttactttgaccctgtagtattgaagtattattgtgattacagctcaaattggtggaaaccctggtctacaggccatatgggaagatgaaaagcaacggcgaagaaacagaaatgaaacttctcaaatgagccaacctgagtcacaaggtataaacctaatagtgctctgattattcttttaaatcaagtattttaatggaaaagtttgtcattgagttgttcctttgacattagattttacttttcaaatgacctttatattttgtatgtatttttcttgttgtcattgctgtacagccactatttatctttacagctgtctccaattgtcgcttattatctctttgtaagaagttgacgtttttactgttctttgtttttaatgtaccttgtcctcttgcctcacttttttgttttcattctctagtatgttctagccctctgtatttccaaatgagctatagaaaactcacagaagatcatgaatctcaacttagaaacactgtttaatacattaagctttgaaaatgtagccattgaaatgctgcccacagtttattttctgagtatgtcatataagctctcactttgttcaatatgtacagctctaaagaaacatttattgctaaatg

SEQ ID NO: 15353 - DNA, 1822 bp, Homo sapiens
ggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctat

SEQ ID NO: 15354 - DNA, 1173 bp, Homo sapiens
aaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaagcctgctaaaataggatttttttttacaaattttattttaaaatgcaaatatttttagagaaaatttttaaatcttaagtgttaaaggtaagcattcagtttaagagatttaaatgatatgcttggcattata

SEQ ID NO: 15355 - DNA, 1187 bp, Homo sapiens
atagatattttaaaaattactttccttttatttttcctttaaattacaagtaagtttgctcttcctgtctgtgccagggtggcgcatggtctacgtcgagcaacagagacactcaggctgtgttctcacgatgactgagtgggagacagcagcaccagcagtggcagagaccccagacatcaagctctttgggaagtggagcactgatgatgtgcacatcagtgacatttccctgcaggattacattgcagtgaaggagaaatatgccaagtacctacctcacagtgcagggtggtatgccgccaaatgcttccacaaagctcagtgtcccattgtggagcgccttactaactccatgatgatgcacggctgcaacaacggcaagaagctcatgactgtgtgcatcgtcaagcatgccttcgaggtcatacacctgctcacaggcgagaaccctctgcaggtcctggtgaacgccatcatcaacagtggtccccgggaggactccacacgcattgggtgcgccgggactgtgagacgacaggctgtggacgtgtccccacttcgccgtgtgaatcaggccatctggctgctgtgcacaggtgctcgtgaggctgccttccggaacattaagaccattgctgagtgcctggcagaggagctcatcaatgctgccaagggctcctccaactcctatgccattaagaagaaggacgtgtggccttcttggagcatgtggccaagtccaaccgctgattttcccagctgttgcccaataaacctgtctgcccttcagggcagccctaccaaaaaaagcaaaaaaattacaactaagttattataatgactttaaaaaatgtgcatgttgatatacaatatgaatttcaagaaaggaaaagggagttataaagcacgttataaaaagaaatatctggccaggtccggtggctcacacctgtaatcccagctctttgagaggccaaggcgggcagatcacctgaggttgggagtttgaggccagcctggccaatatggtgaaaccctgtatctactaaaaaaaaaaaaattagccgggcatggtggcaggtgcctgtaatcccagctacttgggagactgaggtagaactgcttgaacccaggaggtggaggttgcagtgagccaagatcttgccactgcactccagcctggc

SEQ ID NO: 15356 - DNA, 1960 bp, Homo sapiens
agaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcct

SEQ ID NO: 15357 - DNA, 1187 bp, Homo sapiens
actttattacaactcaaggcttgttagagtccagattctaacatggcatttctagaagaggagcccctcaaccagaaatttggatgaagtgcttaaatccatgaggcccagtagtttgaatggtcactctgacatcatcaagtgaagatagtccatgtagagattagagcagaaatcatttcgggcccaaacccaaggatcacaaatgataaagaaatattcctcttccagtcaccaagggtttccctttgtgcatactggttgtccttggatatttttagaattgtccctaatatactctgcactgccagtgctctgggtagcatttgtgtgtcgcatcttccacattaccatgttatgtgttattttcactgccatcagaaaaccatttaatttttcaaaattaatttcaggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgc

SEQ ID NO: 15358 - DNA, 1230 bp, Homo sapiens
atttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaaca

SEQ ID NO: 15359 - DNA, 1133 bp, Homo sapiens
ttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaa

SEQ ID NO: 15360 - DNA, 1111 bp, Homo sapiens
tgctttccatccctaggttctttccggcatttgtaatttccaatccacttaggacacttctactcctcagaaaccgtttctgtcggggccgtgagaggagacagtataagacttcctggacccaagggacgccgggtcccctggaagcgcccatcgcattgaagaccacgtgtgccttgctggggtcccattcagacaagtcccgggtcgttcgctcatcgccctccacgcgaccagggggcgcccgcggtatcggcccggctagttcgcaggcgtgcgccttccctcactgcgccggaacgggccacgttctcggacccagaagccgcgtcagaattccacgctggccaatcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtctgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtgaggcccggtgcggtggtggggggtggccgaggcgtcttggaccgctagaccgctggtctggcgggtggtgcccatggcacgagttgccgcggcctctctgcaaatcacagcgctagcgctttcgag

SEQ ID NO: 15361 - DNA, 2857 bp, Homo sapiens
atggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgactttttttttttgttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaat

SEQ ID NO: 15362 - DNA, 1199 bp, Homo sapiens
atcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtat

SEQ ID NO: 15363 - DNA, 1201 bp, Homo sapiens
aaattgtcacatagaaagtacatacggtggctcataccactcatgagtgctgggtggtaatcccagcactttgggaggctgatatgaaaggattgcttgagcccaggagtgagaccagcctgggcaacatagtgagaccacgttgctccaaaaaagaaaaaaaacattagctgggcgtggtgctgcacacctgctgtcccaactactcaggaggctgaggcagaaggattgcttgagcccaggagtttgaggctgcaatgagctatgatcacgccactgcactccagcctaggtgacagagtgagaccctgtctcaaaaaaacaggacattttgaaccaaaacaaagttatttcctcctttaatcctgttggtcatttggaattggacctcctgatcacttcacatagtagagtatatttaaatgaggatggtcagataggaaaggaagggaaatttcagttggggtttcttgaaaattattgctgatttctgatctttctgcttttcctaggaaggaatgtaatattggctagcttgtgccctcaagtgtttggaatgtatctagtaaagcttgctgtggccatggtgctggctggtgggattcaaaggactgatgctacaggaacacgggtcagaggttagtacctatttagaaattttgagtaatattgacacatggatggaagctagaactttttctttcccaaataaaaactgctcgttgggttttattttccaattgtaatcttataaaactgacagttgtctgaatatcttatacttagtctagcatctgtatatcagaagctactttctagagttccagaaagactgaaagaagttacatttttctatggcatatacttttgctatagcctataaggatgccacaaaataaaatctttgtttctattactgtgttttttgttggatccccggtctgttttcaaaaggaaaaagattagaaatagtgtattttaatgtctccagtcagcgtctctccatctgtggctgtcactgtgtttctcttagactgctgctttcagtcatctgcctgctgattctccttctgctggtagatagcaaatgtgccatctgccatggggtgctgctgcaggtcacaccttcaagaaaagattactcttaagtgtataattatgtccagatggcagaaagctcttttgcagctaacacacttaa

SEQ ID NO: 15364 - DNA, 1180 bp, Homo sapiens
atcattccatgaatataaagtataccaccagaactatatgtgtaattgtatttcttttttcccaaactttaaggtatatggaagaaattgtggagagtactttgtccttgttaacagttaaacataatcaaagccatgttgtctcacaaaagattttggatccgatctacttttttgcattagttgataccaaggctgtgtggttcaaaaagtggatggtaaggaaaaatagaatatttttataccttttagtgcattgctatatcattttaataaatagttaatgtttgaatactgtgtgctaagagttctaatcacttttacatgtgttagctcatttatttcttataaaactttacgaggttggtggtattaatacccccatttttcagatgcagtaactgagatatggagaagttaacttgcccaagatttttcacctattaagtgtcagagccagaataggattttaagtgatatttcatttgaatctaagctgaatgacctattcaaaaatctattttttctttaatgtgaaagcttcaaaaattttaagcaaatgtggtagaacataaggattcaatatgtattttttttcaggcttaggagatatttctgaaagtattctttcatttgccttcctcctgaacctgaagtttggggaatgtgtttaatacctgaacctggcaatttcttatgaagctgaaactgaaactactagtaagagtagagagatctttatactgttacctccctcaacctctgttaactaagagaggtctgtgtttgtcaatagcagcaacaggactggcttttatgctcacattgtcttctttctcaatctgtactgggcacctaggtactatatttcttgcacttgagaagagaggggttggggcattcatttactcttcagcacagtttggatgttatctagcaatggtgctttgtgccttctgctaagttgtatcataaatgcccaattaaccagaacacaattctgtctctagtggttagcccttacctggcctgtctagtatgtgattcatgtttactcaattaaattaaattaatttaagatgaaccctttgttccttacatctaacagttaaatttttttcttgattatcaaattatatcattatttgagaaaatatgcaaaatatgtaaaagcttaaat

SEQ ID NO: 15365 - DNA, 1734 bp, Homo sapiens
agatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacatagcttctatattccgtgtgatttgtttcccctgccgagatggagtcttgctctgtcacccaggctggagtgcagtggcgcgatctcgtctcactgcaacccttgcctcccgggttcaagcaattctcctgcctcaccctcccgaatagctgggattacaggcaccgccaccgcacctggct

SEQ ID NO: 15366 - DNA, 1214 bp, Homo sapiens
agccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaaggtaagctgtttttctttaatgcctttatattctgttgcataattgcctttctacaatttgcacatgtaatacccacattagtacatttatttgaaaacagtattttctcaatagagtgtatctttgctgatagcattaacaattggggagaaaatttacaagatatggtatctattttggaacttggactgtgacatagatctctagatacctacttcaaaagtcgtttacttttaatctttcaagttactttccttttttacctttattttctaaatctagaggagtttaaactgtttttgaagaaatctcaattctaaactgaattgcattatgttatattgtgttctcagtagcattcattaata

SEQ ID NO: 15367 - DNA, 1212 bp, Homo sapiens
cacttcatggcctcctttggtaatattcttgaagagatatacattattggttatttatggccaagtttaaatattgatgcaggtaaaagatataggtgcaataagaacagatgacacctgacttctaacactaaacgtccctgtttttttgccctcacttctgtgcaaagctgcagctctcagtagcagttttgagcctctgagtgtttagaaagaaaaattgggaaaatatgaactgtttggtaaaagccaggttgaagtggaaaggaagggcatgtgtctagtttatgcctctttatccagcttgatctgtgtcttcaaatatatagcaggatagggactccatagtcatgtccctgaatgggaagacacctcctggccagtatccttgccaaggtaaacactgtcaaatgatcattttcttggtttagaatagcaaatatttgccagaataaggaggggcactatgtgagtgtatgatactgagtttgaataacaggcatttgttttgtgccacatgttcgtgagcaatttgtgggtgaaccttctgtttacatctcttcctttggctttgtagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcaggtgaggcctgtccctctcataaagaatattttttaataatttttcaaaattcccaacagtagagagactagtaccatatacttccatcacccagattccacagttaacaggattttgccttctgtgtcttttatctttgttttttctctgctgaaatattttgaagtaaatcccaatcattatggcatttcacccctacatatttcaggatcatctccaaaatgcaaatggatcatacttccaaatacagtcacattctaaggagcttttttctatcaccatgaagtggaaaagtataatgatatcccacagcctaaaaactggaaagttggggtggagtgagatctggatttggaaacagttgcagaaataagttccagtgccataccagtgcctttcccaggtagccaaagtagtgcccacaaaccttgcctgcattttggatgtgatggagagtcagtcaaggccatagtgtgttgtgc

SEQ ID NO: 15368 - DNA, 1103 bp, Homo sapiens
gacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctc

SEQ ID NO: 15369 - DNA, 1165 bp, Homo sapiens
aaattatttccaggtaaaacagaacaaaaattgtatgaaaagtaacgccaggaataggttttgtatagaagctctccttttaaacactgctctttggttataagctaagaattattattggaattgacagcaataatttttaagccaaaagtgtatattttagctaaatgttccagattacgcagtaaatacccaagtgagtaattggcaagaaatgaggtaaatgagttcagatattcaaatgattaaaagtaagtctgcatattaatagtagccttcaaagtaattctgatgttcatatttaatatcatttaacatttatacatattagtcactggagctttacttggagtacatccacacgaaaaaccaattatttattaaattttcctttcttagcaatagcctctaaatttgcaggcccaccccaaactgttcctaaaagatctctttcgttctgtaatgcttcctccaaatatagctctctgcctgaacaaacagattttttcaaagctctaattacttccggtggcccttggatgaattgctttagccattcttgtgcctcttctagagatttagtttcatctgaagactgcaagacctcttcaaccattcctatgtttagagcattttttgaatccagtttaagggccccactcaacactttgagagcttgtctacttccgattatttcaactagccgggtggtgccaccccagcttggtattatgcccatctctttgtggacgaatctgatcttactctctggagtcattaacctgtaaaagaaaaaagaaaagcttaattgtaactctctctgtatgctctaatcataaagtactatccattcatgatctgatgtgaattctccatagatctttataggtaggtatattaaaaacaatgtttgaaaaatatggctgtttcatctagaatttaatttactaatagtatttaaaacttccctttgaaaacagtatcattttttgttgtgcttgtttaccctttgcaaacaagaaccttctaaaagcccaaagttgatctttcttaagtgagtggtgacctaatgagaggatgtggatcaagtgaaagtatgggagtaggaaatgttaggtgcatactaagaaaaacaaaccgaaaagcatagtaagttaaggttctc

SEQ ID NO: 15370 - DNA, 1329 bp, Homo sapiens
tcttctgatgatagaattatagctctttttctcattctttatgtttgttcagaatgtgtatattctttatatttgtacagaattgttctgtaatgatcaaatattactattataaacagataaaaaattatagatatttaaaaaattgatagaaaatatgcggcaaagataaaatgtctttttaagataaatttcctttttcttaaatggatcattagactcaagtataaaatatgtatgcctagatattaatctcatatatagaaaaaataaattgtaatccttgagtaatctaaattggttgtcaagtttcatttggtaactgttattcaacattagtctctttcttaagttttctcactctttgtgttttgacatctttcaggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaat

SEQ ID NO: 15371 - DNA, 1180 bp, Homo sapiens
gttttaaccctttgtggtgggggtgttttgttgcaatactgctgtgggaaggcaccaccctttcttgttttccacataggactcatatattcatattttttatacttattctgccctctaatctctttctgcagccatctcattcattttcatcccaactaccattccgttttgtacacttatagctatattattgcctctttatctcacaagttgtggtatgataaataagtgatgtttgtacactgtttttgcaaaaaagctcacagtgctttctgggggtatctactaattaatctttacagaatccctatgagatagatagggctggatagggtattcagcacacaattcactagaccatgctgtctctctattatgataaaggattattattatgttaaaatgtttatacactgaatacataaatttgtagagattgatgtaaaccgaatcccttggcaaaaatatgaacatgcctgtagcataaaattgcaattgtgaagcaggttttatcaacttctggtgtttaaagaattattccagatttgcacattaaacctctgttggatagcttgttttcgttatcttgcctcttggggaatgacagggagcagtgagctactgaacttctgggatttcagcaagtgacaaactcagattcttgatagcgttatttaaaaagtatagcaagctcctctggcttgtgtgtgactcatctacatgtatataatagcttgattgacttatataattagtacttttatgtttatatactgataatatttgtggaaatctagtcaggtattttatgcttttgcagagtttgatgtggattagctgcattgccttttctacaaaagcaaacaccctgaagagttgtctcctttagggagggagcttcactcttttcagtcaacagccatgtatagtcctaagatgctttagtagtgtttcccccaccgtagcatatggattcactggggaaaaacacaaataaaccaggcagcagaaaagaaaagctagagaatcagttctttgctaatcttatgctatcacttccttctttttttttctctcaatgagtccatgttgcttttctctctttaccttccctttaatttcttttagctgttgaacatgtcaaaaactgcagctgctcatgaactcctatttcagc

SEQ ID NO: 15372 - DNA, 1764 bp, Homo sapiens
gaaaacttgatgaatgttacttaacatttttttcaagcctgtgtttttggaatatttaagccttctgttttttttttttttttctcttctagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaacttgtcacttctctttttctaaagggttaaaaaaacaaacttgagtgatatttttcatcagaagtcttagtattttgtgaaaagtagcatttcaaaatctgttttcagctcttctgtaatttgatgatgctgccaacatcactatttgaaacggtgaaagcgacgttgaaagtttgtaaatctaatgttgagagtgccagattccttctgcctggttacataatccattccagcttttacgaattctccgagggatatttttgcttgttttctttgtgcatttttcattttgttttcaggaaatattttagctgtaccatctgaatcttgctcctctgcttcatgtccttctttactttgtgtccactggccctctgtatatcaggcaaactaggccactgaggggctgcatcccagtct

SEQ ID NO: 15373 - DNA, 1200 bp, Homo sapiens
ttgaattttcagaaaagcatatttagaaccatgtatttttaactaaatatccagtgttaaatataatgatggagagaaacaacttaaaagtctttattgaagaaaaaattataggccagaacttgtacaaataagaacacataagtgatattgctaaaaataagaatgagaatgactgacaaaccttgctggttgttttaaaaggtacgtgaaaaaacgtagttttagaattaaaatatagctgtaaaagatcttgaggattattgattgactcagttttcatctaatcatacattgaatactgtgttttagaaaatgattaaagctttataagtgtacaaaaatatagagtgtggtataaatgtttatataaatagctttatgatatatttgaacacaagtagtacatttcttaacagatgttaatttatattgaaatcagtgagctgagttattttcatttaggatatgtttaaataatgacaagttaaataatccttttttttctgtttgtgatatgttaaaggaggaattaattccaatgagtgtgaaaatgtatcaagaaaaaagaaaatgtcagaggaatttgaagccaatactatggattctctggtagacatgccatttgctactgtagatattcaggatgactgtggaagtaagtactttattaagtaaacgcgtatttagaagcaatgagtagtaaatttagttatatatatatttttttctttataagttgtttcacttttaatacttatgtttttgagttttaattttgatttcatttcatttattctagttttttgagacacagtcttgctctgtcatctaggctggagtggtgtgatcacagttcactgcagccttgacctgccagtcttaagtaatcctcccacctcagcttcctggtgggaggtagctgggaccacaggcatgtgtggcaccatatgtggctacatttttatttttctttgtagaggtggggtcttgccatgttgcccaggctggtctcaaactcctgggctcaagccatcctcctgccttggcctccaaaagtgctgggattacagatgtgaatgatcgtgccgcgccaagtcttgttttttatttaatagttgtctatatctattggtataataataataatgttatattcatatataataatatctgtgataaaataatcacagataatat

SEQ ID NO: 15374 - DNA, 1181 bp, Homo sapiens
accaaatcacctggagggcttgctaagctgcagttggctgggcccccagccacagagcttctgattcagtaaatctgggataaggtctgagaattttgcatttcttgtaagacccagatgatgctgataccgctggtgttgggaccacactctgagaatcactgggctagtgcaatggattttcctcaaagacactaacatatgtagccaaagggtagagacacttcattcttttttttctttttaagattggcggaagtatcaacagatgattgaagaagctttgaattcaggcttacttagaatttccatttaggaaatctaggaaaaggaatcttggagataatctagtcaagcttatgtattttccagacacagaaattcaggccttaattgctgagttgctcaaggtgacctagagtttattagtgtcagaatcaagtctagaactggtttattaactccatatccagtgctctttctactataaccaatgaaataaacttctaatcctctttttaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctataggtaagtcaaaaacctaatttgcattccatttggcaaattgttgtatccatacaacaatggagtttatgttttactctctgccttccagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttagatcaagatgtatgactaatatatgttatgccaatctgctctatattgctttgaaggatttaatgaatttatactatatcaagcattgctgtcacttccctaaagagccggaaattttccaatttctgtttttgtttgtttttgttttt

SEQ ID NO: 15375 - DNA, 1186 bp, Homo sapiens
tgatgaatgaagcatggctgtaaatttatttatattcaaaactaatttgtttagacaactacaccttctttgaattaatcttaggttgataaaaagttcttgaacagctgaagaataatatatcaatacttagtttatatcaatattttaaaagtaaatacattttactttcaatttttatttaaaagtacaatatacatcaccacataaaagttagatcttgaaaaggattttagtttttaggaatagttcccattattcctctgctctcaattcaggtttcactgtgcaaatatttttttccaaggtgtatttgatttgccctcccgatgtccttaaccagaagggaaccacagaagaaaacactgctgaagacatccattctcattgcttgcgtagacctgattcactaagaaaataggaaaagcttaaatgaaaaacattctagggaagtgacaaaccatataaggcaatgggtgagccgcaattgtgggcgtaatttttttctctctctctttgaacagggagacacatcgcctctgcctcccactgtcccagactgtctgcgggctgatgtcagggttcctccttctgagagccaaaaatgttccttctatttagcagacaagaatatcacccacggcttcctctatcctcctggttagtagaactcttttttagagcagtagcttagaaagctctcatcagctggatgtgggcatgtgccttaaacatatactccccaccaaaactacctgcttgggtaagctagctgcctgagaggcttccagtggttgtggctggccagagcagcacagcggctgtaataaagactaagacattttgcagtgggacccacacagcagctctcatctggcccagatgtttagagagttcggcaggtttaagtttaattttaaaactggagattctttgcagaaggacacaaacatctaaaaacccatttcttctgactcctgcccaagctaaggtccacctggagaatacagctgtgcccgtgaaaagaaatcaggctgggtgctcgctttggcagaacatgtactaaaataggaatgatacagagaaggtcacctagtaaaataaaataaaataaaaaaagaaatcaggctggaattttggcctgtcgctcatgctgtagggctaacagttttaaactgcaggtgaa

SEQ ID NO: 15376 - DNA, 1175 bp, Homo sapiens
caatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaagggcttggttattcatttatccttctaaacat

SEQ ID NO: 15377 - DNA, 2036 bp, Homo sapiens
ttgcagtgagccaagattgtgccactgcactccagcctgggtgacagagcaagactccatctcaaaaaaaaaagaaaagaaatatatgtgaagaaaagttgccaatttgtacttactgatatcttcagagaactcatttttaagaaaaactttaataaaaggtaaagaatgtttaagctcgtaagctgttctttatttttattcataggtaacctcagtctcttgtttaagtcagtaacttatttagtggtgtcttctttcttaaggtcagccacacccttagaaaaattaccaatgaaagttgaaaaattgctcccttaattgtagcattagttcaagaatttttttgaaagaatagtgccatatgtattaaagagatttttgaggaacaaaaaaacacagtcaaaaatttgagggcaatatactactactgattttactctagaaatgaaccaaattatttttagttgctgtagaggtactccactaaatctgtaaacatgtttttttgttttgttttgttttttgcgtctgcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcggtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagctcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattt

SEQ ID NO: 15378 - DNA, 1184 bp, Homo sapiens
aaaagaaaggacatgatttggtttgtttgttttgacagagtctcactctgtctcacaggctggaatgcagtggtacgatctcggctcactgcaacctccgcctcccaggttcaagtgattctcccacctcagcctccctagtagctgggattacagacatgcaccatcatgcccggctaatttttgtatttttagtagagaccaggtttcactatgttggccagtctggttttgaactcctgacctcagatgatccaaccaccttggcctcccaaagtgctgggattacagacatgagccactgtgcccggccagggacatgatttgattctagtaacatttgaaaaataaataatatagattcattttttacatttcaatttcaaaattgtgaaaagtgaattaacaacatttaagtttaatgactttattttgttttatttctcaggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggagtaagtatctgagttttcgtatttgtactacatagcctaattttatagttctatgactaatactaaaatgtattcattctacagatagtttatgagcaccttaccatgtgctggttgtcctggatacagaagtgagccctgtaaaagcaatccctcctctcatggaggtgcaagcttttgtacatagagtgctggtacctgaatcagcaaagaactcattggttacagagacattttattgctctctcaatttattttaactgaagaaagggacctttatattcgcacatgtacctattcaaatatgattatatttgaattatatttgaatgatgccttaatatatattataatttttataatattttaattgtcatattctttaacaaaggtagatggttttctttcataacaaactgctgaaaataatatgatttatatcttaacctggacatcttaaattttagtttttgttaaacctgtaatattttaaagcctgaatattaataagtaataataaaaccttagtgttttgagattaacattataaaagacat

SEQ ID NO: 15379 - DNA, 1200 bp, Homo sapiens
gcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttccttttttttaaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacat

SEQ ID NO: 15380 - DNA, 1103 bp, Homo sapiens
tctaccatctccagagggaacgctgcttcctggaaccacgggctcgtttctatgctgctgaaatagccagtgccttgggctacctgcattcactgaacatcgtttataggtaagcctgagagctcttcaggctaccagttttggtataaaggagacgtagcactggctgtttcatagggccttaaaataatttgtgtttatttgcaacttggttgcctaaaaccagatcccctagcacgtgagctggcttgacttaagtgccaagggggaaccagccaagtaggattgtgcctaatccagaatagatgagcagaacaagggctcccttttttcttcactacacaactacagtgaacctaaaatgcctctaatacctttagcaattatctttaagaggatatcttatgaagtgaaattaacttgtgcaactacttttctattcacttttttacagagacttaaaaccagagaatattttgctagattcacagggacacattgtccttactgacttcggactctgcaaggagaacattgaacacaacagcacaacatccaccttctgtggcacgccggaggtaggcgctgtcttggtttggtgcctggtttacccccgccttccaagagagagatgtacaatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaaactttctaaatccctaagtaagagatatcaagtgcccagcagtttcctaaatgtcagtacacataggtagccagtcaccctcaaaaagtccagcagttttatcaggaaggaatctaaagatatctatcttccaagctggctctgggtctctcagctttttcaaactaaatgtgtggtcgtgggattgcttgctttcgcaggttctaaacgctgtttccctggtctgtttttcagtatctcgcacctgaggtgcttcataagcagccttatgacaggactgtggactggtggtgcctggg

SEQ ID NO: 15381 - DNA, 1454 bp, Homo sapiens
gtgtaaaaataggataatagaatctacctcctagagttgtgttgaaatgaaatgataacgtgcaaagcactcagcacataaaaagcatccaatattggtagctgatatcgttgccatcaatatcacatttaatctatcaaggcattctttctaaaagagcattctaaaaataagatagagtcatttgtggagaataatggagagattatagtaaattgcagaaatggcatgactaggaaaggaagaaagttgcaggacaaagaaaaagattttctcttgatataataattctttcaccataattttccctttgttgttcttataatgtgattgattaaattacagcaaatgtcttttttttttttgttttaacagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagac

SEQ ID NO: 15382 - DNA, 1175 bp, Homo sapiens
agtgtcttcctttttctccctactcatgcatacaagctacctaataaacacttattccttcttcagagtgccagatgtctattctcaccatcatggattctttggtgcacctttgtgtttctattgtatattttacatattatttgtctcaggacaatgtaattgtttccatctttctcttcactagtataatatctttatgggcagggacttacatttttatttttttttatccccagagtttagtataatatctggtactacgtatttattatttctcaataaatatttgagaaaggaatgaacctttctttggtaatatgagtatttttatttgcaaaaaaaaaaagtaaagtgtggtatgccatatttagtagagatgttaattctgaaatgattattatttaatgtccattgaactactagttttatatgactacttgagaactaagtatagttaacggtattaatcatcagataacattgctgtatgaaccataagattttggtatgttttgcagatcaaggatctggattttgcataactggtaaaatagaagctggttatatccaaactggtgaccgactactggcaatgcctcctaatgaaacttgtaccgtgaaaggtatttatctgcaagatgcttttgctaaacaagccttaagttgagacagcagatttttaaaaagtggtttagttacaactccaaagtaagtaacctcttactgaaattgtaactgactgtcaaaatgatactgactgttgaagattaaaatgtgaaaacattaaacgatttttttctgttgtgattgtgtctgtatatatatgtacataaacattctaactgtagtagcattctatttttgacacagatctgagaagcctggttaggatttaatcagatatgtatagatacctcacagatgtatttggaataatattctgtagcagaaattaaatctagtcccagccttaccctaactagtcagtggcaaagcagccttctacagtctgttactttgaaatgtatgtttcagaataactataaattaacagctttgatcatgtttatgccaaaaatgtaggtatattttataggaagatataagtaacattcaaatggagaaaaacccaatgttgaaaagagaaattgaactagtttaaattgccagtc

SEQ ID NO: 15383 - DNA, 1099 bp, Homo sapiens
cctgtctagtgctcagttttcctcagtttatgaggctagtgcctggtttacatatcttatagactgttgttaaaattaaatgagattaacattcattttataagctgcaactattacttggttgaatgtcccttatccgaaatgcttgggacccaaagtgtttggggtctgaaattttttttttggattttggaatatttacattatacttattagttgaacagcccaaattcagaaatctgaaatccaaaatgctccaatgagcatttcctttgagcattatatcagtgctcaaaaagtttcagattttggagcatttcagatttcagaattttggatttgggatgctcaatgtgtatattagtgacagttaagttgctattagtaattataaaaagtagttattttctaggagaagtgggattataatgagtttattgaagtgagtcaaaaatttaattttaaattaaaccttgccttttgcaatttcttttttccagattcctttaagcctccccagcgatctattgacaaaccttttagattatgtgtgtccgatgttttcaaaggtaagtgctacctttgtagtgcttcttcagtatagccccttttccccattccctcctaacctcctttcctggactaagttatgacagtatattgccttcagagtctctcctctccatgcccaagtaaggatcactgtcagattaatcttaaaatgcacagatttagtcacttagcttccctgtccaggaaaaccttcagtttactcaccatttctcatctttcaagcataagaaaaccttgccttttgtctttctaactttatagtttttttttctcccattagattcctttagttttcaaatccttcaaccaaactggattgtttattgtttcttaaccacacaggatgtgtttattgccacatgtctacccgtgcttccctgttgtattgttctttctctttacttgtccatttcctccccatctgtaacagtctgggtccagttaggagttagataccatacataggtgaaatgggaaatgtaatataaagaattattaactatgataaaaatgcaactaaaagata

SEQ ID NO: 15384 - DNA, 1149 bp, Homo sapiens
actggagaagcggcaaggagggaagcagctactcaacttagtggtcattggtaatgctctttgtccctctggatcgtcagccagccatgccttagcctgcccactgtctggaggcagcatggaaactctgagtttctccatgggtggaatggacagagagcaaggaggcacagtctcataatgctttctagtcatgtggggagagataatgccaagttaccaaagaggtcattacacttgattgtgggatttttcattttgtgaacattttgaaattggcgtgtcttgttgacaattttaatttccaaaaatctgagaaattccccccgtctgtaaagagatatgctcttttttttttctattagatgttttaactgtcatttgataaatactggtattactgtaaaccactgacatgaaatattgaattacacatttatgcaatgcctcaatgtgaacatctggaaatgtacctggtattaatcctgaatcaattttctttaggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggtagtcactatatttcaaaattttcagtttgaaatcatacagtcttctaaaataagtgtgtaatatgtgttgaatttgtaaaacatatgaaatactttagagattatttttagaaaatagcttttagatatcagggaactattttgacttttttgatgtaatctgcatactgtttttactcttctgaattttatagaaatagattaaaagaatgtttaaaagaaacaaaataaaagccatgcagaaaaacaacagtaaaaatcataagctgattattctatgggataagtttcagttgtcacttccctaagtatttgtcaaattgtcttgattttgaattaaaattatgagtaagacttttaatttcatgtcagcttacaaaggaaaggtaactgtcataaaacctcttctgtgtagaatctaaataaccagcaaattcaaattaccaaacaattcatttttatactttacatattatg

SEQ ID NO: 15385 - DNA, 1105 bp, Homo sapiens
cagtattttagtaagtctagtgttgtgtgcaagtaaaatatatactatattccagcacaattcagactctcaacttgttcatcagttcataaacctcgcaggattaaaaatagtttagccatctgctaactgaccaaacaattttagtattgtgaaagggtgtggtaggaaagggaggtatagggtctaggtataatgtcagaacaaggctcagtgcagaaactaccttgtgacctcttaatactgaaacttaacagtcagttcaaaattaggaagagatttggtggaggttaagcataggagagtcctgacaataggggatttcctagattaaagtgacagaatttctttcagcattaatatcttactaaatttttttagagataatgtgtttataaagacattaattctgtgaaagttatcataatctataatttaaaatactatgtaatagatttctttatattactaaagaaattaattggccttttatattttactccttaactaggaaaaccagtagattcccagacatcgcgaagtgaatctgaaattgtgccaaaagttgctaaaatgactgtatctggaaagaagcaaactatgggatttgaagtgcctgggtaagactttgagtacctccctcatccccacccccacccccaagtttttgaaatcactgttgcttctgtaagaaagagactgtttcaatttcgcataatatatcattagcactgaagtatcatatatcctcagtataacatagtacaaagagacaaaatgagaaattaggcttgattctggccttatcttgtgtgtattacttactctacctcactgccagttttcttacataaatattttatagctactttaacataaaaaaccctatgattttgtgaaacctagcactgtgagatagggaattcttataccactaggtggcagaggtaaccagattttggagtgagtccccgaatcatggaatcattaattaaattttttaataactaaaatatttttaaactcttttggattttcatattgaataaattggaccattgtagcaaagacgtaaattggaccattgtagcaaagacatatgata

SEQ ID NO: 15386 - DNA, 1112 bp, Homo sapiens
gcagaaggtttcattaaattcagcgagtctgtatcagttgtgtgatgtgagagagatctacctttgcatccttcacaaatgaatatacattgaaaaaaaaatcttcaggaccaaagacctacatcatttcatgttcaagagaaaacctagaatctatttagatcttagccgcaggaaggaaccaggagagccctggggaaagcagcttctcaaggggtaaccactggggacagagtttctaattatgtttctaattatggggatggaggcagtttctaattatgttttgctgcagaggtagctggaggatgagaaaggtcaactggacaggcagcgaggtaatttggtttaagtgcaagctttgccactaaggtgaagtcacttatttgtcccttgtttctttgtcaataaaataagattagacttgatcagttgggtagcccttcagctgggtggctattatttctgtctgaatgaaaactgtacctaacggatgattagttcttctctattctagagactgaacactaattatgaatatatgagttttcagaatatgtatcttttgggtgatcatgatttggtgggtgggttttgtgaggcctaggggaggacattaataatctttctttggaatggtgcattttatttttatctcatagtgggctagttgatttaaaggacatcttagtggtttaattcacctcattataggaagtggaaattttacgtacttcatggaaaagtttagaggaaactgaagctagtgaaattaaatgaactgcttaagccgtaaggtgacagctaattagtggtagggcagggaccagaatcaaagcttccttctttttcatccagtacttatttcttactgtcatattttgggacttactgaaaatttagtgttcaatttcttgggattgttaaatggtgaatgaatttccagttgtttggggaagatgggagaacacagtaaacattttacattttaaaaaatatggatttgattatatatatgtatctcttattgatctatgacttgctattttagttatgagttcctttctgacttatgtcagtagagtttgcctgccttccagaatggtgctagt

SEQ ID NO: 15387 - DNA, 1157 bp, Homo sapiens
gcctcagcctccagagtagctgggactactggtgcccaccaccacacccggctaatttttttcttttttgtattttttttagtagagatggggtttcaccgtgttggccaggatggtctcaatctcctgacctcatgatccgcccgccttggcctcccaaagtgctgagattacaggcgtgagccactgcacccggcctgttcttattattttttttaagatggagtctctctctgtcgccaggctggagtgcagtgacgctcactgcagcctccgcctcccgggttcaagtgattctcctgactcagcctcctgagtagctgggactacaggtgcatgtcaccacgcccagctgatttttgtatttttagtagagacggggtttcaccatgttggccaggatagtcttgatctcttgagcttgtgatccaccgcctaggcctcccaaagtgcagggattataggtgtgagccaccacgcccggcctaacttgttctttacaataagtaatggaatgtggagttttcctttttgctactgacagttgtgtgccccacagtgacaaagtttcagcaatgcaggatcaatagaagcttttctaatcagtagaataattatgtaattcatcccttaaagcagtggttctcaactagcaatcagaatcactggaggaattacttcagaacacagatactgtggcttcactccatatatgctgaagcagtctctgtggaatggcatttgggaatgtgtattttcaaaattattccccaaaatgtgtatttctgttcgagaaccattgccttaaagggaggaatcagtagaatgagttatcaatgccaagaataacatctgaccaacttgaatgaataatttctagaaatcaggaataccaaggaaaaatgctacttaggaattaatggccctttgcataaaatgatggagatattattagtattccttggaaaaatataatacagtagtatctaaaatgttattttattagtttttttgagacagagtctcactctgttccccaggctggagtgcagtggcatgatctcggctcactgcaacctccgcctctcgggttcaagcgattctcctgtgtcagccccccgagtagctgggattacaggtgcgtgtcaccacacctg

SEQ ID NO: 15388 - DNA, 1181 bp, Homo sapiens
ctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacat

SEQ ID NO: 15389 - DNA, 1138 bp, Homo sapiens
tgactttctgctgcatctttatgactaaggtaattttgggaaaaacttaattttatctcattgcatttggtgtaataataagtggacttggattgacataataaaaaaacaaaactcaggattctaaaaatcagtggtaatttagcagttgagatcttccaaatgattgtctgggtaaccttcagtgcttgggttgctaagtagtaagatgtagttattctcttgatgatggaatgtatttttgttgaaaaattcagttttactggttttgttttattgtgttttagaatattaccaatctcatatacccaatcttcagaagattaatactgtgatttatgattggagaaatgatcatctttacaagaaacatttcattgacaattgtttttaacctttctgtagcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggtataaaatttcaacttgtgattctgacagattttttttgatataggtttggtgggtgaattatttcatttttaggaacaattattaatatggttccttttcactctccgcatcttttgttaatctttaattttttctctctcttttaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaa

SEQ ID NO: 15390 - DNA, 1756 bp, Homo sapiens
gttgaaaatacaaatgaccataataccattaagaattaatagtagttgatgctcattctttttcccccaccaggcttaactttatattatgtatgtatttaattaatagtatctcactgatagttttttgtaatcttttcccccatttaactatatattatgccatgccattaaatattcttttacaacatcaatttaagtgcttgcctagaggtactacaatttgctaatatgtcctaatgcatgtgatatatataacacatgcgtgtgtgtgtgtgtgtgtgtgtgtgtgtgtgttttgtgccttcatttgtaaggtctttaaggtattctctcagtatttaccttagtgaggctttttgattggaaaccattaacttttgtacagatgagttttttaaaaaagtgtatttttgcctttactgtttatttacatgttatattcaaccagagtatttagaatggtagcatggaatactttatttttcttgcattgatatttatttcatttttagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggtaaaaactaaaatacagaatctagattataatattgtttttgttctttgaattctgtttggaattataaacgtaaaattgtgatatgtatttaactagcggtttttactcttgacttccttcattttaagataattccaaattgtttttactcttatctggtgaactttggaagctaagtgttttaataaaaattaatttatccagctactcaggaggctgaggcgggaggatctcttgagcccaggagttcaaggctgtggtgagctatgattgcgcctactgcactccagcctgggcgatagagcaagaccctgtctctttaaaaa

SEQ ID NO: 15391 - DNA, 1143 bp, Homo sapiens
ttttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgc

SEQ ID NO: 15392 - DNA, 1253 bp, Homo sapiens
ttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgctttgctccttttcctgaacctgcttttggctttcttcaactgctcctctggcactcttgtgtgtaaaaccaatcacctgcaccctagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcggtgagtagctgttgggagcagctgggcaagtctgggagccagtgctgttcctgtgcagactgtacatgaccctgagctgtggtgtgggcgtaagagggggagaccgtgacatccaccatcccatctttcccattgatcatgaatctggctagctgggcagtagtgtcccctcacttcctcttcacttggggattttgctctccctaaacatttgaatttgaagatgaaagctgttctttgttcaagcatgtatgagtggacgccctaccctcctggagcgtccatacacataagtacaatgccagaatactttcatttttgaaagtaggaaaaccaaatggcctttgaaggggaagtgggcttggactgctgccttggcattttatttcaaccatatccagaagctggctgaactctaaatgtggttcactcaaaagcaagataaagaatttttatcctgcttggctaatccctgtcaaggccctgtcaagggatcttaaaatttagtcaaaaaagtattttgaaaacattagtcatttgctatatcactaattcgtaaaaggctgttaggctgtgctataaattctgattttgtaagtgaaaaatataatttgtacttattattacgggctgaggtaatgttaattttcaccatgctataaatgcaatgaggt

SEQ ID NO: 15393 - DNA, 1226 bp, Homo sapiens
aataatactattttttgtcattttgcatttatattctgtgtattctagcctttttccttataatttgaagaggcttaaatagaataaagatgtagtagtaaaaaggcatagctggggagaatgttatttagcccatttagaggaaaacagaattcatagttatttgtttagatatgtggctctttcatagtggaaaaagagattatgataattatatagttctctgctaattgtattcatctttattgcatgaaaaacacaaagtctaattttggtgcacagagtttattctaagaaaccataaaattgatatgaaagtgtaacgtaggagtgtcatttcattattgcttttgctccttatttactagtaaattcacttctctgagttttattcatattatcatctatactgccaatctcaattgtttctatgaactgttctctgatagagcaaaatcttttaaagtatcaataaatgtctgttgattgtgagggtctcagatgacctctgttaggtgaaattaagaatatcttcccaaaattctgttctagaaattcctgaattgcctgtatttcatctaaattcttctggcacaaatactgaagattctgaacttaccgactggctgagagtgaatggagctgatgaagacactataagccgggtaaagaaaactgtctgtgggacaagtattctttcacttcgtttcataatgttgggtgcctgctatgtgacaggcacaggggatacactggtgagcaaatcagacccagccctgccctcctgaggcttacagaccagggtaggcacgtgataatcagctaactccacagatacaaatgtgattctacactggtaaattctatgaagaaaaaggtatcaggtgtttattagatagggcgagagaggttggggaaggttgttggagaagggaatgaaagagctgaaggctaacagaatgtgagggtataaataggccaattgtatgtatgttcaggaggggtgtgggagggagaccagggaagaaccttgtgcagtggggctgcagtgtgtacaatccaacgaggcaggcaaaagctctgtggtcctgagccccttaggaattttatgtatttgaaatgaaaaccagaaagagtgggaaaaaaataaagacaggactaaaagaaaaaatttcttgtttctaattctttgtatgttaatttttattttattttattttatttta

SEQ ID NO: 15394 - DNA, 1225 bp, Homo sapiens
aaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactcgtttttgtattcatttattcaagcacttaggcagtctttcatagttaagcagaatatttttatatccactgcttgtttccatgcattaatgctataggattatttgctaattgttcatatttaatatttaaaacaaccctaaaaataatatttttaaatggtccttataggtctatatttcagtgcttaacacccagtgtgcagaacactgttctaagtggtttgagaagaa

SEQ ID NO: 15395 - DNA, 1834 bp, Homo sapiens
ctgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttgtttccagtttgtagtttttccatttttcaaatctggggaaaggaattaaaaaaaaaatgggtaataagaacatgggatataatgaaaagtggtttttgtttgtttttttgtttgaagttttaagggccttgctcattttaggtgtccaaaaccaatttttgagtggagattaatgaattctaatagtctattccctgaacttttcctcaatgaacaataccctagacacacattaaacaatttctctgcagtgctatcaaccagaggaaaatggactaagagatttctggcaggttcagacacccgggggacatgtgtgcagtgtagctgaagcctcctccttgtgctggggtccccttccattcaggtggtggggtagcagtctctctattttccccttgccctccttcccattttatcatttgttattttttttcccac

SEQ ID NO: 15396 - DNA, 1161 bp, Homo sapiens
ttagaggataactgataattcttaagaatcagatttaaatgataattttaatgcaattttaatgtaaaaattctataccattttattactaagatctccaaaacaaatggaatttactgtaattaatattgacttatcactccacctgttttaagaggtatgattttttttgtgtacctcttttagaagagtagtatttcatatcaaaatacatctgtatataactcatgctcagatgcttgatttgctctcattgtggccgcattctgatttttctagcatggggtagggagtggggaagcgggggtgtctgattggcagttctgtcttgtggtctggcatggccctgtttgtagtgctgattgcaggggttgacttgctacagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgttttattttaactctgtaaggctttaaatctcttccatagagattgcaataaatcattactatacttttgattgtgaactcctcaccttacattacaagtgacccagaataaatataaaatgttgacggaaaaatagaaattactgaattttgttaaacctatgaaacacaacttgcagtgcaacctctgaattactttgctaaatcttctccagtgatcttttactccatctttctcatcatgctgacttgtctctcctctgtctgttcagcagtgggagacatttagtgaacgctcttcaagctcacaaactctgacccaatttgattctaacattgcaccagctgatcctgtaagtcaatcacttagcttgcttgtttgagattaattttattaacccaaatttccattcattatcgtttttagctgatatgcatgattcagtggagtg

SEQ ID NO: 15397 - DNA, 1192 bp, Homo sapiens
cgctctctcctgcagactctaaagaaatctggactttctgtgtatgattttagagaatgctgtgttgttaacaagaatgctaaatgttcatatttattgggacctttctttctttcttccttttctttttttttttcttttttcttttttttgagttggagtctcgttctgtcaccaggctggagtgcagtggcacgatctcggctcactgcagtctccacctcccgggttcaagcgattctcctgcctcagcctccttaagtagatgggactacaggcacgcaccaccatgccccgctaatttttgtatttttagtagagatagggtttcaccatgttggccaggatggtctctatctcttgacctcatgatctgcccgccttggcctcccaaagtgctgggattacaggcgtgagccaccatgcccagcctggacctttctttaaaaagaaaaagaatatcaagggctaaaaattagtaaatttttcttaaattctgaatgaataaaaggaaacctaatgtttaattcttaatgagcctaattaaaataaattactgtcttcagtgtttccatctatactctcatttgtatatgatgatggaaagaattttatacttttaaaagggaagttcaaatagaatttgggtctcaaatgggcatttatctatcaggcagcatctctttaacctaaaaatatacatggtctgacttagttgtctaaattacgcagaaggaatcagatgcatgaaattactgtcacaaaagagaacagtctccttggagtcagtaatctgaatgtgcttctagttttgctaatttaatctgtgaccctgggcaagttctaatcatttactgtatttttcccttctgtttctccacctgaaatgtggatttgatgccattcacatttcaggacctgaattgtacactgaccttttatcaacgaataggttgattgtaaaaatatggcattgattttaatttcttaagcacatttttctatgataatcctaggattttgggatcatttcagttgtgaagcgtcagcctctgacttgagctgaaagcttagtatctttattaggtaattttgattcaaagtactttaatttacctacttaagaaataaaaacaacttctttgttaaacacctatgatagtaaccaaaagagaagaacatgtggtaactt

SEQ ID NO: 15398 - DNA, 1598 bp, Homo sapiens
ccagtactcttttaaccatgcatcctgcttctgtccaggtgtgacattttattggtattgcatttttatttgcttcattcagagtattgctccagtcgttgtttttatattttgctgttgcagattttataaatgcaaatccactcatttatttaaaagcaaaattctgctctgtgcatttcaaatctgttatcattggaatgtttcagctgattttatttctgtttctgattccctagtgaagttttgaaaggtttctgcatctggaaatatatttgcttggctttcttagcacattttcataactttctgttgcttacataattgctgtcattctactcgtttctataatcattgtgcaaaaacatatccaataatctgactgtaacagatgtgtggttttacattttaaatatacacaaaaagcaagttttactttcaaagataaataacctagcaatcttggtccatataatcatgtaggtagatattgtactgaggaaaaaatgtttcattacaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggtgagttgttgaaaacagaagttcttctagatgggacaggagaatctcaatttcataatatcaaagacattgttttattggtcatagattttaattataaaataattatcagattatttgtctaaaaagaatttataatcactgggggccaaaaacatgacatattcacatattaaaaatatcttttcccagttaaaaaagtctaagactcttacattctgttcgtggatccgtaagttcagaataacattaaacaacactgttttaatatttcaggatctgcagctaaagagttttttacaaaatcaaaacttcctattcttgaactttctcatatttggtaagtgtggtatatcattagttgggtaactgggttgcttccaaggagtttctagcagatagattttagagccttaaaaaataaacaactaaccccttcaagaatgctgtcaaagaactcagtattgccttacaatagccagcttctctcttattctgcagaaaagaaataagtgatactgatacagtagttctttgtaaagagctaaaattctttaagctgtatcagctgtttttttgttgctagcataatgtatgagataaaagttagtttgcacatacatggttatatttatcccattggttttttatcaagtttagtaagtcctataccatgccataagtttaggaatggtgttagcttccatttaaccagagacttaagaatagctgtgttggaatatggttcgaattggctattagaacacaaagtgtaatcacaaattactttataaaaataggccagggccgggtgcggtggctcatacctgtaatcttagcactttgggaggccgaggcaggtggattacctgagctcaggagtttgagaccagcctgggcaacatggtgaaaccc

SEQ ID NO: 15399 - DNA, 1141 bp, Homo sapiens
cctggccaacatggtgaaaccctttctgtactaaaaatacaaaattagccgcatgtggtggcgcatgcctgtaatcccagctactccagaggctgaggcaggagaatcacttagaacctgggaggaggaggaggttgcagtgagccaagatcgcgccactgcactccagcctagatgacagagcaagacgctgtctcaaaaaaaaaaaaaaaaaaagagagagagagagatggtagagattatgaaggtaaacgtgataggcctgggttatttggcagtgttttggtgagaatacagtggggcaaggattattctttggacaccactcacagttagaaaaggggcaggaagagggcttactttttaaaagagacaatgatgagtttggtttcagacattcttagatggcaattcagatctcttggagacagtgggaagtgggtggagatttgtccaccccaactgctggttcttacagcagttcaggttcagaggttcgggatttcttcctctgttttgctcacctaagtgtttagggacgggagacagtgtcacatagactgggcatgcacatacatatcaggaccttggttggtacagtagttttcggtgtttgttagtaaaagttaggaggagactgagtcatctgggggcatgagtgtagagaacaaataacaccgagtccagaaccaaacgaggaaggagctggcatttatcgagtgcctattatgttcctttaaccaggcaaatcattttcatggaagaactcatttgattcttgcaacaaccttgtgaagtgggtgttattcttgtttatttttatttttatttttattttttgagacagtctctcgctctgttgcccaggctggagtgcagtggtgcaatctcggctcactgcaacctccacctcccaggctcaagcgattcttctgcctcagcctcctgggtagctgggactacaggcatgcgccaccaccacactcggctaatttttgtatttttagtagagtcggggtttcaccatattggccaggctggtcttgaactcctgaccttgtgatctgcccacttcagcctcccagagtgctgggattacaggcttattcttgttcactaagaacttgatagcagataagtt

SEQ ID NO: 15400 - DNA, 1373 bp, Homo sapiens
tgtctgtttcccccaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaataca

SEQ ID NO: 15401 - DNA, 1171 bp, Homo sapiens
tttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaacattgtactctgtctttagtttgtcactttatttttcattgagatttttgagcagtgggattgtctggtcagaaaagatgaagagaaagctttctgaggttttgatcactattcaggtaaccatttcaaagtcactcctgcagctaataaaaaaaactgccaacttttttgctgcttgcgtcatgtatcacatgtaaactcactttgcaataaaagctttcagtatgacaaagttgattctatacgaatagtccaaaattatcgttccggttttagggaattctattatttgatagatagtatagtgttaaagattagatagacccccaaggtcaaccacccatagccacatag

SEQ ID NO: 15402 - DNA, 1247 bp, Homo sapiens
ggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataacttgttttctagaagtcatttgggggtggttgttccctttggtggcttttttccccccgtctttgagttgaacactattgatgagagtaagcattccaaaggataaattacaggacactaaaacaggtcatgatgagcttaagcgg

SEQ ID NO: 15403 - DNA, 1193 bp, Homo sapiens
aattgtatatttcagtgatataaaatttaagaaaccttaagaaatttttacatggatggcacaaacatgtaaaatactctcatgcttaaaacaagctaagcaacctggttttctttacataaagtttgttattcactttttttttattgaaggtgatacttacattccagctcaaatgagggttgaattggtttagtctgtgtgtattgttccatgaagagagaggctaagtgattttagcatagacaccaaagctgctatccttgtttgtccttattgcttcttgaaggaaaatcttaattcatctaagttattatgtattgccgtgtctgtggtttatattagtaataaaaagacaattgaaaagaatgaagaaaatgtatcaaagttcatgtgagattgactaaaactactgtttttacatagccttaaatatgttttttaatcttaagcataagcatttgcccaaccttacagaacactttttatattcttataaatatcccaattgttctttttcttctaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaa

SEQ ID NO: 15404 - DNA, 1115 bp, Homo sapiens
tttctaagttttattttctaatattatcaaaaccttaataagagatttctaaattgaataatatcaatatcatggcaacaatgtgagtggttagctgtggtgggagggctcagtgattaactggaaaggtcattggttgaaacatcaggaaactgaggttcttgctctgaatttcatagaatagcttgcagagcttgggcaagcaactcaacccttcactgtttcaccactcagcctcgtgcttttgggggtatgtgatgtgtgtgtgtgtgtgtgtgtgtgtgtaattggactttagtatgtgtctgcaaaacctctaaaattatttctctatttaaaacatgaaaatcaagaccccatagagatctttaaacaaatactgatatggattactgtgggagtcagtcccttaatccagatgtctaggaaatatccttcctctaagcttctaagtgtgaagggcaggctccatggaaaatgttcattgtgctcatgtaaattgttaggaagaaaaaaacttgctacaagatttgtccaataagtttaagaaatggatcatgagcaaaaatgtgaaaaggcactttctgaatcttccttcattctctctggcctctgtggccattcttcctcctacttgacctgaattttagtgtcgggtagggaaatgccttctaccagctccagaggtgtgaactataaatgtatggactttattggtttcaaattgcagaaccacccctccctcacccctaagatgtgttatcactcactggtattcagctatggttttgtagctggctgagatggggcagaagatttccaagttggtcaattaagggtgtaactgttgcctccctagcctctgggactggatctgagccattgtgttacacggctacgaggtattaggcataaactttgtgagattctgaagaagagtggaagcaaaaaacctgatggaactgctttggtgacagtcttgaaggagaattggttataagccaagcttgatttggaccttacgaacacacagctggggagggtcattgctgccagtatttatggggcctctggggcaagagttcaaatggaggcccacaaagattcttcatttg

SEQ ID NO: 15405 - DNA, 1097 bp, Homo sapiens
tatgtttatttcagagtttcttaaatttatgcttactaactggcatagataagaagggaaatggtggtttaaagtgtacattcaatcaacagcaagggctgaactattgaaaatgttgtgttctgtgtccagaaaacattttattttcacataattgtttaagtgtctccaatgaacatttacaatatttatgggggtatagtgcttgtggttcagttagctcagtcttaagttctgtgcctgggtaatggtgtgttgtttagcagtaattctgaaattaattataataaaggagaaaacaccagagaaaaatatcggtttactgctcctagttttacaacaagggaacactgttaggagttccaaagtagcgttagtagttcagcgttgagatattttgtctcctcacccccctgtctccaacatcctgtttcatcacaaatgtttatcattttactcattggttctccacccgtcttgtgggctgctgtggttgctgtcacccagccaagaggctggggaatgcctgtccacaagcagtaaggggcatctggctagggtgctcagaagttcctgagcattgtagtatcagcattgtgaggccattgagatagggagagaacaagcctatttaaatagctgccagaacaatcaatacaagcaccattgttgctagtcatagtggaaatatacacactgtctttagcaaagaaaaaactgaagtgtacaccatttgaagatgtcatactgaggtgttctgaaagcatcaaaagagaagaagaaaaattcctatctaaacaatattactatcttaaaaaggctattctatttgagtggttgttaactgttttaaagaatggtttggtttgcctgagaagtttatttggtattaattagctactcactttaaaaatatttaatatgacacaagatacaatatgatagtaccatggcacagtctacttgtttcagatggaattgacattttggaagagtatgggccaggaattttgtagtctgggcttatgggttttgggggcagaataccaccaggcgaggttcccatctcatcacattatgttaggaattgtgtcaca

SEQ ID NO: 15406 - DNA, 1173 bp, Homo sapiens
aaaaccattcttagctcacagttctcagctatggaacagatttggtccaccaagtataatttgccaaccctagctctatagcatggaatgcttaatggaccactagtaaataggagcagataaaaataactaatgcttaatgagcacttatgatgtgcctggtatttaacaggtattatctcacttaatcctcacaaaatcccctgaagtaagtgctattattgccagcattgtataaataaggcatggagagtttaagtgcctaacccaagatcacaaagctggtaacttctataatagttaatggatgaataacagttgattgggagtgatgcctaataacagttgattgggagtaatgaaaaagatgatatatcaaacatcttttggaagtgtacctccttacccatgttactaatatccccaaagtttattaacatctgaaatctgtttacataatcatgtatatatatgttgtttttatgggatacagcacacattttcataggcctatgtttattctcaactttctcattccatcagtgtatccctggatatcgggctgaggaagcagtggaaatgttaaagaccttctacaaacaagaaaatccaaatggtcagttttctgttgtggataatgtccttcccttaaatccatacaaagagaatctgctatgagcttacctcttcattttctttttcttttctattcttttcacagcaccaaaatcgaaagttcggaaaaaggaatgtcagaaatcttgaacatgttctgatgaaagaaccaagtgacccaaagtgacctggacaagattcatagactgaaagctgttgacatcgttgaatcatatgtttatatattgtttttaatctgcaggaaaatggtgtctctcatcatttgctctgttaagggaacaaattagcactttttagaagtctgacaattgtaaacagttattagcttttccagaagctgattcccattttaagatgggggaaaattaaggtttgaggttttagaaattagcaagtagtgcatacccttctagccacaagtgcccagtccaggcaagtgctgacttcttagagaatgtgtggccagacccagggacctggagtgtgtttggactgcagtttgccaccctgagaacaccttctccaggactggcattt

SEQ ID NO: 15407 - DNA, 1268 bp, Homo sapiens
gcctcttggcctttaccacaaaacttagagctgaattcatcgcttgattgcagaaattaattcaaattagctatatgttttgcaaactataatgttatattatcatctttgctaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatataaaaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgac

SEQ ID NO: 15408 - DNA, 1290 bp, Homo sapiens
ccatcatgcaacattctctgatggggcggggatctccatggaggggggaggcacacttgttgcgtcgcctcagcaactccaattgcgtgacagaatgtgcttccgcttccgcctctgagccctatgagcgagagttacgctacttagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtgggtttgggtgagggagcgcatgccagtgtccatggccaggcacttagatccgccgtgtctacctttataattaattccccgactgccacttttcccaagagcgttattttcaggcccacaatgccttcagtattgaaatttgtggttattgtatcccatcttctttttctcctgttttaaaactctttgcagtctttgctgtcattgtcctccctagcctctttaaaatgcatccttttttttttcttgggaatttgtggccatgtctccagaaatgacaagctggcaagcgagttcatccattctacattcaacaaatatttgttgagct

SEQ ID NO: 15409 - DNA, 1610 bp, Homo sapiens
tgtgcttcctatctcccagctatccaggacccaactctagagaaagctaaatgagaattttgccagactcctcgtttgctttcactaggactcttctccttcctgcccccattatcctctcatgttttattttcaaattttataaaagataaatgttgttttatggagcaatgtctcaacatcactttactgtgagaagcactttacatatattatcttatttcatttattttatctaatttcccccatttcaattttacttgtttattctttaagtattctgcctctattttgtttttcctactttgtctttatttatatttccattaaaaataatactttcacatccttttgaaattatatttattcctagttcagcctagaatttttgtttttaatccatatttatatttttcataaaagactaatgaatctagcttttttttttccccgctcgctcccctctccaccttagcaccgctcaggctgcactgcgcttgctgcaagcttcaggctcctgctaagctagtgctgcatcgtctcccttcagccgccatcatgattatctaccgcgacctcatcagccacgatgagatgttttccgacatctacaagatctgggagatcatggacgggctgtacctggaggtggaggggaagatggtcagtaggatagaaggtaacattgatgactcgctcattggtggtaatacctccgctgaatgaccctagggcgaaggtacagaaagcacagtaatcactggtgttgatattgtcatgaaccatcacctgcaggaaacaagtttcacaaaagaagcctacaagaagtatatcaaagattacatgaaatcaatcaaagccaaacttgaagaacagagaccagaaacagtaaaaccttttatgacaggggctgcaaaacaaatcaaggacatccttgctaatttcaaaaactaccagttctttaattgtgaaaacatgaatccagatggcatggttgctctattggactaccgtgaagatggtgtgaccccatatatgattttctttaaggatgatttagaaatggaaaaatgttaacaaatttggcaattactttgatctatcacctgtcattgtaactggcttctgcttgtcatccacacaacaccaggacttaagacaaattggggctgatgtcatcttgagctcttcatttattttgaccgtgatttatttggagtggaggcattgtttttaagaaaaacatgttatgtatgttgtcgaaaaataaaatgcatttaaactaaaaaaaaaaactaatgaatccaatttgtatttttattttattttatattttatacctttttatttccttgatcatcagtctaattgttttatcttataatcattacattcatatttaatctgtattttaatttcaatatttgtttttttttaaattttctctctttcttgtataattttacttaaaatttttcttttttcttttttttttgagacagactcttgctctgtcatccaggctggagtgcagtggtgtgatctcagctcactgtaacttccacctcctgggttcaagcaattctcctgcctcagcctctcaagtagct

SEQ ID NO: 15410 - DNA, 1165 bp, Homo sapiens
aacaacgagccaaatggtattttcaagatacctgctagagttgtaaggtgatgtgaaaatggttatgatttttgctggtgacacagtcaaagctaccactaataatgtgttttgtgatctgccatcacaatggaaggaaatgcaaatttctgttagaggtcagtgaaaagatctaattgcttttcctgtccaagttcatggaccccctgcctggtaataacccctgataaagatgatggcttaaaatgagtatttgtttccttaaacctcagcagtggcagcagtgtgccacagagtgtttcaaaagagacaacaattttaaatggaaagtagtcttgggtgaatgccccatatggcaggcactgcactgggtgtagttgacaaaactgatgagctctatgatggcatctggcctcttgagtgtgtagactagtacgagaaccagacatcaaattgcagagcatacaaatagttgtttaactgcttagagggtagacattctgcagtgctgtcatggcaaatcactcggggacttcatagggacctggaatgagtgatagtttgagtggtcagggaaggccttcttgaggaatctattcaagtccatagttcaaggtggtggagggcactggctgaaggcagagctgtgtgcaggctctaagctggcagaacttggcccacagaaagcctgattgaggccggtgattgggagtgaagtgagcagagggctgtggattaaaattggcagaaagatgcagtctgcatttcactcagtagtatttcttatcctgattgaaggggcatggtttacctcttagtttgagggcatgtattatttagtgcattaatggatggatccctaaaagcattaggaattagtctggagtatgtaggttgaaaaataggttataaaattgatgagaacaagctctcttgcaagagttagaaacataaaaacaaatttttctaaagctaaattccttaacatttttcctcactcagatttctatttggcttgaatctaaggaaaacctgagaagagaggaagtgcttggcttctctgtataccaagcagtttcaacagtggtgtttgtagaaatgcataccttgctgttcctaggcagataagtgttgtcacacgtcttcagattttaaggcgacaggc

SEQ ID NO: 15411 - DNA, 1214 bp, Homo sapiens
atcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaa

SEQ ID NO: 15412 - DNA, 1193 bp, Homo sapiens
tgtttaagaacaattagtttggctgtgatacaaagaatgaagagagcagtgcacaggctgcttgcaggagttaagatgaggagagcagtgtaatatttgagatgcgctgccatttggagtagattgagagatttatgccttgctacatttaaaagcaaaaagagcctggcaaagggaaagccagaaaaagaaagtaggaataattaatattccaaagagcaaaaaatgagataagattgggaagcaacagagttcagattcaaaagtatgaaagtgtggtaaaatgtaagaatagaaatgtgtttgtttctttaaaagctgaaatttagctaaaaaggatagattcttaaattgaagaatcaagctaaatacttgagactagaaatgcctttgttgtgatgttgttatgtaatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaaaatacgatcactgaatgaaatatgttaatagaaaatgtctgatttttaagtgaattttttaataagtgctttcaaattactttcccagtggaaatatttatgtttgttgttgaaactgaatgattttacaaatcattgagcttcttaacaaacaatagaacagaaaagaatgtacatctttcattttaaaatgttgcttcaatttacaaagactgtcaaatttatagtattctttgccaaaatgctaggggaaacaatatagctaagtcctactttcttcttgtttcataatgtctcacagtatttcttttttcaaaataaaaaatcttctgtttattgttatgaattacagtaatttattagctcataataatctgctctacaatctttgtaatccaactgaagagtgatttgaatggccatgaacgaggtagtcttttaatatttgctttatttgcatagtggttatgtgtgtgtgtatatatatataatatatatatatatg

SEQ ID NO: 15413 - DNA, 1191 bp, Homo sapiens
agaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaat

SEQ ID NO: 15414 - DNA, 1244 bp, Homo sapiens
ctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgatttt

SEQ ID NO: 15415 - DNA, 2277 bp, Homo sapiens
tccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaagatgactttgatattcttcagctggattcactgatagaatgtgagttttgaatgcacatttatgaaaacaagatatagagatagcctgtgtcctgatacatctacattttttcctgcagtttctctcatacacactaatacagtctcctgttgctctcattctctctctctccccatctcttacacatacatataattatatgattctcaatttattttccagatagaaggtttattgatagagaaaa

SEQ ID NO: 15416 - DNA, 1136 bp, Homo sapiens
aatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaatgaaaattgtggaattctttgatttctgagacttagaacatatggggttttttggttttttctttcaacaaaagatatcaaaatggctaatactatagaatcccatattttatatacatttattacatcttaaaaacaattgtgacagtttccaattgttcaaaacaagtacaaatctgatcctcacattttcttggctgcaaacaaaggattttttaagttttctttctctattattttatagcctctgaaatattactgtgtttagaagtagttgttcttaaatgggtgctatgctaatgaaccaatgagacaaaatgagatagccgcaattgttagagtagtcccagtcattaaacttaaatgtgtttggacctggagaatcatt

SEQ ID NO: 15417 - DNA, 1200 bp, Homo sapiens
caaccaccaacagaattattgttgaagtttggagataatgcttagcacagtatctgaaacataaaaggcatttcataaataatagctcttattgttctactttttcataccattgtgctttcacatatgctattgattccatcctcctacctacatatagcccttttctctttttgccacctatgagaacctttaagatatacctcaggttttaactcctctgtgattttaccttctccgctacagaattggtctttccactgtgatgctgtcatgttcacatttattacagtttgttgcacatcagttatgtaattcatcttccacactaaaacatgtctttctccaaacaggtatgggatctgtctcatagcatgaatgctcctaagaaaatagagaggacttagtaagggtataaatgagtgaatatttcattgcctttagtgagcctttttgcaataactgcctgtattgattatttcctaggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagtgagagtttctgcaaaatcttttgagggctggggaagaagggtgaaaaggaattaggggaccttgagtagtttaatagtttaagcatagttaacctgtagtactgatattggtcaaaagtttgttattaaacactacttgtgcttttctcttgtgctttgaactacataaccctttgaaattagttctgtactctgtgactcattgctctatatgaaatatatatttttcagtaagatgtctgtttatatatgatgcagatcaaagtaaactgtgtttaggaacttctgtaagcatttctgctaactgggagctcatcgtgtagcctctgatagctttgaaccaaagttgactttgacagtcttttaaatcagaggccaaatggtaacagaaaatactactttagaggacagaattttgattcagcctttgaatgtcatatgtctttattctgttgtcttt

SEQ ID NO: 15418 - DNA, 1230 bp, Homo sapiens
cttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataa

SEQ ID NO: 15419 - DNA, 1129 bp, Homo sapiens
acgcctgtaatcccagcactttggggggccgaggcaggaggattgcatgaggtcaggagttccagaccatcctggccaacatggtgaaaccccgtctctactaaaaatacaaaaattagccaggcgtgatggcgcatacctgtaatctcagctacttgggaggctgagacaggagaatcgcttgaacccaggaggcggaggttgcagtgagccaagatcatgccactgtactccagcttggactacagagcaagactgtctcaaaaaaaaaaatgcagatttctgtcttctttttgaacattggaagattcagcaggatggacattgcacttgccaattggcagcaaccaactggaggaactgtgtactggccgccccctttattagggacactcaatatcctgttgtgggtgtctcacccgcctccctgccccctttgttttcctagagccgaccactgtactcatctgtgggcccaagtggcatttgtggtgctgagtttatgttttcattattatttgctttctcttttcctcttacacaagagacttcccaatggcagtaacttcacttgtattagtagttcacagaatgaaaggtacttcagtgatcgtctagtgaagtctgtcttcttcatttaatattacaggtctcaccttcgagtgagtctttaataaatgtcgacaaatggcacacgagtctatttctaggaagtcagcagatgggtagaaaaagccagtggtaaatagcctataacaatttccctggctgtattaagtagtattgatgctgggtcaaactagttaggaggattttcagttctcccatgaaagcaaggctctctggtaatctgatttgtttttcttttctaggaaccctcttcataaatcaaactcagaagacagctctgtaggtcagtaccacttttcttggtttacctatttaattatttcaatactttatagaaaacacgaatatgtgaaaatacaaaacccacaagaatccttctactcagaaataaacactgttaagattttgatgtacatccttattctcctttttctaggcagttttaaaaaaatataattgtgatcatattctgcatactgttttatagtttttaacttga

SEQ ID NO: 15420 - DNA, 1249 bp, Homo sapiens
gacacatggagcgtttctatcatattctttcttaatttatccagattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgct

SEQ ID NO: 15421 - DNA, 1486 bp, Homo sapiens
ttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaa

SEQ ID NO: 15422 - DNA, 1140 bp, Homo sapiens
agtataattcaagatgagatttgggtgaggacacagccaaaccatatcatcgttcaactagaaaatatatatatatacacacacacacacttagtgaaagttattttattaattagccaggataaaccttatttaaactatttagatatgagtcactttgaggaaaggttattatatgaaaatatcactgaaataatcagaaatttctttaaaaaatgctgttatgctataattcatttcataaagttctgcttacattcataaacttgagccgtttgtacagatcacttattatcctcatataataattttctgacacatccaatctgcgtggctgtgataaaaaatgatccaaaatgttgacctataacgtgtcttaagagctcttaaaaaaaagataaaatccttgaatgatgccaggcatctagaataaaattgtcaagagaaactcaactaattttgagatcaaattttaagatcaaatcttactcctttattacaaatgttcagtaacgatctcatcaacatgatgtctgtagcaaattatttttacttaagggctcagctctgacatttgaagtgaatggttgtgagtgccagtttagttcaggaaaatgctgtggttaagggctggcccattttcacatggaataatattattcaggtcttgttttgtggtatttatgttgtaaataatacatccagagtccatgtagctacctatgcctgcccgtgaatgatacctacttagcgttgtcttagatccagtggcaataacgtttaaatgctgaaggaaatatcttttggtttgctgagagttttaattagggttcactttgctgctaagacagcagcatttaagctactaggttcttggcacaatattgtttccatatttctttttctttccagaaggcttaattatttcttcacctgaattttaacaaccattttagctgaatgatctagaaactgtcctcctcaatgtgtgttctgagtcagcagcatcagcatcacctgtgaactgttagaaatgcagaatctcaggcccaccccaaccccactgaatttcttagaagctgcatccaatggaagcatctatatgaaccacacttttgagtagcaaggatctagagttct

SEQ ID NO: 15423 - DNA, 2478 bp, Homo sapiens
tcatgttgtatttcccagagggagaagtgccaactagatagaggttggtagtgatcgagcatgtgtgtcagtgtcagctagatgccccatttggggagcaagctgcatcaggctgtgcactacaaatggtgtttaaagttgcctgtaattttttagactttgtgattttttacttataaaataatttttttctttcttacagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtggattttgtgacttgttttcagtttgtgggacaggagataatttatacatcagcagatcatttaagcattaatggaaatcagggaaaacttcttctctagagtctccttgtgacattgtgatactcagctgcatttcttggactgtttttatcaatttccctagacttcttttttcatagtttatgatagttttcccttttatttcctttggatttttcaaaatttaccgcattgttaaaga

SEQ ID NO: 15424 - DNA, 1147 bp, Homo sapiens
gggaagaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggtatcgccgctgatagggacgagcccctacctcctccctctctccggttgagctgacccctggccttccgcgcgccaactcccaccttctggttcttctcgcacttttaggtcccccggacccctgtctcaggcgcggttgctccgtagctcagagccggtgatggcatgcctgagcctcgtatctcgttgtgttttaaactcaccataccatttgagatgttttggagcaacatttccggacgggagcacaacttttattttccgagagttgacgtttatgtcatctcaagacaaaactttctgttttacaggaaaattatatttcactgtggtctattggagattttggaaacttggactctgatggagggtttgaaggagaccatcagttattgtgtgatatcagacaccatggtgatgtaatggatttacaggtaaatctgtgtagcatccaaaagctaactttgaaagtcctgagtaatacatttaaacaagcagagcatcataaaagttgtctggtgtcacccctcgtttacagaaaactgagtgctctgtaagttatgatttgcccaacatcatttagccatttagtggcagaaaaaggactgggaaaggggatgtagatttaatcatacttttttattaattgactgtcgactatgtgctaaataccgtttggggagctttacaaaaattaattattgttgcatgccagtgaatcaagtatcgttactttgttttactaatgagaaaattgagactaatatatcttgagcatgtactatgtgacagatactgtgcagggggataacatcattttgttttttgaattctcataacaactccctaagtagagattagtgctcccgttttaaagatttaccacgatttagtgaacttaacttggccaaagtctcaaaaccagtaatgagtggtggggatgaaattgagtttt

SEQ ID NO: 15425 - DNA, 1991 bp, Homo sapiens
ttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctattattgactgagctgttactgcattatttggattcaatcataccaaccctattttacaacgggggaaattgagtattagagaaagtgacatgcccagggccacataaagcatactcgagggaaggagaatcaaggtctacaaaatatttatatcaggtagactgaatgtgacttttaaaagtgatcttcttacctgtagattatctgattgaaggagttctgcatctaagacaatggaaacataattttaaagggaaaggtgtccacaatttctctcttaaacatgttcttgt

SEQ ID NO: 15426 - DNA, 1201 bp, Homo sapiens
attcgagctgtctgcacagccacccagttggtagttaacacgatcaaagagattgctgtgactgtgaagaaggcagataaagtggagtagaggaagctgctggagtagtgtgccaggaccactctgagctccaactgatctcacagcagaaagctttctttgctaagatggtggtggatgcagtgatgacgtgtgatgatttgctgcagcttaaaatgattggaatcaagaaggtacaggatggagcccagctggtgttgcatttaagaagactttctcttatgctgggtttaaaatgcaaccctcccaaaaataccaaaatccctagattgcccttttgaatgttgagctcgagttgaaagctgagaaagataatgcttagataaaagtccacacggttgaggattatcaggcgattgttgatgccgagtggaacattctctatgacaagttagagaggatctatcattttggagccaaagttgtcttgtctgaactccccactggagatgtggccgcccagtactttgctgacaggaacatgttctgtgctggccaagtacctgaggagaatctgaagaggacaatgatggcctgtggaggctcaatccagaccagtacgaatgctttcttagcagatgtgctgggtcgacgccaggtgtttgaagagaccctgattaaaggtgagaggtacaacttttttactggctgcctcaaagccaagacaggcaccttcatcctccatggtggtagtgagcagtttattgaggagacagagcggtccctgtgtgatgccatcatgatcatcaggagggccatcgggaatgagtcagtggtggctggtggcagggccattgagagggagttctccaagtacctccaggattcctcaaagactattccaggaaaacaacagctgttgattggggcatatgccaaggccttggagattgtctcattccagctgtacaataatgctggctttggggccacagagattctcaacaagctgcaggcatggcattcccaggggcacgtgatatgaggtggacatcaacaacgaggacattgctgacaactttgaggccttcgtgtgggagccagctttggtatggatcaatgccctggcagtggcctcttaggctgtgtgcctgattgtgtctgtggatgaaaccatcaagaatccgattgactgtggatg

SEQ ID NO: 15427 - DNA, 1145 bp, Homo sapiens
ttgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattct

SEQ ID NO: 15428 - DNA, 1195 bp, Homo sapiens
gtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagc

SEQ ID NO: 15429 - DNA, 1215 bp, Homo sapiens
gtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagta

SEQ ID NO: 15430 - DNA, 1204 bp, Homo sapiens
gttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaccagcaagttttcagtgccagataaaactctgcgctctagaggtaactcctcatgggaggcagctaggagtgttacctgacaccagtttcctagaaaactgtgacaagcaaagcaataacacacgtcgagaaatatctgatcaagcgggaaatcttctgactgtcggggatctctagtaagatctcttggaatgaagtgcactgtgtatccaaaactattttccagcgccagtgaagttgctcttacctaaaacaaatgggtttatgctagtttccaccaaggaatgagtctcgatggccattaaactttctaaggcccacagggctaggaaaagtcgctcttaaaggtcaggtgtttggaaaatgtttttccttttgcccaacccttaattagtagtagagaatgttctg

SEQ ID NO: 15431 - DNA, 1772 bp, Homo sapiens
attcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctg

SEQ ID NO: 15432 - DNA, 1038 bp, Homo sapiens
tctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggagga

SEQ ID NO: 15433 - DNA, 2043 bp, Homo sapiens
tttcccccaggatggtcttgaactcctgacctcaagtgatctgcccgcctcggcctcctaaagtgctgggattacaggcatgagccaccgcacccagccctatctttgttttttgtttgtttgtttgtttttgagacagaatctcgctctgtcgccaggctggagtgcagtggcacaatctcagcttactgcaacctccacctcctgggttcaagcgattctcctgcctcagcctcccgaatagcagggactataggtgcatgccaccatgcccagcttatttttgtatttttagtggagacagggtttcaacatgttggccaggatggtctcgatctctttacctcatgatctgccctcctcagcttcacaaagtgctgggattacaggcatgaggcaccgcgcccggccccatctttgtttttttaatggagttaaactatggtattattaggtcactttgacaactatcctgttgttaataaatgagagagaaaaaggagattttatttacgctgattcttcctcctcctacagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgccca

SEQ ID NO: 15434 - DNA, 1695 bp, Homo sapiens
tacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaatctccttggttttattttctagtggggaaaagtcaagaaaggaagattaaaaatgagatttatataaaaagagacataatatatattctagatgttgccaaaagcagttattaaatatcatttataaaaggttattagtctatgctcttgctaagtattaaaaaagatttttgcaaaatgtttatataaagctgtacattttgaatctactgtgtttctttatccacatgtgtgcctattttaaagagtaagtttgta

SEQ ID NO: 15435 - DNA, 1755 bp, Homo sapiens
aaggtataatagaaggccttcaagttcagaaagcttgcctttttccacttaactctcttcctcggttcttaaaagcggaaaatgcaaaatgtagtactgagtaattttataagaaatctaggtttttcattatttcttcagtgtttctaaattagaactcaaaatcactgaactttcaaacaatgccaagcagtacctaatattcatagaaatacatttctacgtactttcctaatttcatgtttcttttgttttccacattgagagcgaaatgaagaggacactaatgaaatccctaatagttctaattatactataattaaatttaaatgatcattaatatcaggtttcttaatgtcagagaataaattagttattatctagagcaaagttacattttgaccttgaaagttcttttacatttcttactctaaatctcttatgttttaagatttatgattagacaaaaaattacctcagagaattcattgtgtcgactataagtagaacctttctgatcaccttgattggataacttggtttgagcatcttttttgagagaagtctgggctgctgatttctgaacagaagccagtggggttctgaacataacatattctctggttgaagcatgaggtgaaaatttattgttgttttcctaatttaaaaaaaagttttaatagaatttagaaattatttcctgtatcctcaatgagacatttttatgtttgtacatataagaaatgacaaacaagattaggtaagagacttatccctacatgcaatttacctgcacgtacttaaacaaagcaaaacctaaatactcacacatatcaagcctaacttatagacagaaactgtgaaccaaatactatgggaaatcactttagatgcagtctatatggtacttaatacctaaaaagtaaaacagcttttccaaattttccagatgttataaaatacacatacacacaactggcaactaagattgactaaatggtcgactctatctgagaaatgagtaattttccctttgttactttagacattctatttctaggaagaatccaagaaataaatgttgagttgagatttctttatttttgaatgtggtttctaagttccagtataaggctgaaatactttatgactgtaaagaagggtttccagattacctcttttcttttctatttctagaagagcactaacagtgcatttttaactaaaaacatcatctgcaaacacttacggtaactctttgtattgctttactgtacaactggaatgcccccttatcatcttctaggatcttcttccaagttgtgctcactttagacacactggaaaagtaaatcaccataaatgaaataattaaagcatcacaaagagctaagatgaatacagtagaaaaacatcagcagtgcaaaaagatattttatattattagtgcttctcaaacctgaccacattacaattgcctggcggttttaactggtctaaaatgaagctcagggctctgtatttttaaaaagctccctcctcattaagtaattctgagtgcattgaggcttaagaaccactgctttgtacagtattttttcacaatatctgcaaacatcaaatagtagcccccactgtatatatgataccatgttagctatctggtaaaagtaatagacaaatttcaaagtactctaggcacactgctattagaaatcaactttagaaactcactatgttaacagaaaaagtaga

SEQ ID NO: 15436 - DNA, 1187 bp, Homo sapiens
acatctgaaatccttctggtactaagcatttcagatgagggacactcaacctgtacaacagcctttgcatgagctggtggtactgagccactaacagcaatgttcagtgtattatgctaatatgtatattcaaaacagtacttacttgattaagtccatgtcactgagttgtgctaaaatagttgctaagacatgtctgagtccccttcgaaagagttcgctgagaatatctacacattctaggcccatttttctgccaattatattctgcagtctaaaatttcctctggctataatttccttcagcatctcccgatctactttaggatttcgttttgcattcttttttaatgttgaacaaaccactttttcaaaatgaagaactggcagcaagtttttgttgggatattggtctgggctttgtatttgtagcaggcaggattgtagactgtcaccgaaattctcctccaggaggctaccttcttcatgttcactgaggccactttgtagagaaaatgaggaatagccactgtcttcataaagtctactggtctctagtgcttctatttcatttgtactattaagtgtctgttgcacatgttgattttccttgttatgcaagcgcttgctttcagtttcaagttgtacaatcctagggctcacaatcggtgacccaatacatgacagcctttcatagtctttaatgcagtctttacaggaaccttccaaatatgcaggggtgtaggaaactagtcttccaatgtcatcaggttttaccagtttaagtccggaatgaacatggttacaattaaaatcacacttcattttgacagaaagggtagaactttcttctttacaacctataaaaagaacataacatttacatcttaatggcaaaatttccacacatccctacttcttaaattgggatatacaaagattactttgcaatctctcagcattaggtattgtctacatgtacttgcttacatagctgtgatgttattcaagtttaattattgatatgacaataatatgtgaaaatattacttaaatcttataagtacatacatattatattattcttgagaaggcacttcagaacagactgcttttggatctgcctggctgtaacacctgactgttgtctataactgattgagtaaaaaatagtggaaaaaggggct

SEQ ID NO: 15437 - DNA, 1107 bp, Homo sapiens
acctgatgaaattataaattaaatagtttaaaaaggaagaacatatagcagattttgaacttgttgcagtggtgaaattattgatagtttttctcttgttcctctgcattctgattttcttgaaattgacttctattcgttgtgttactaaaagaatattgatttatatttttaaagtgtgaataggagttgaaaaaagtcttaactcctattcaagtctttctagaaatattgctcaagaagaagaagatagttttttttttcgtctgggctgccaacatgccatccagactgaggaagacccggaaacttaggggccacgtgagccaccgccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctccccaagcaggctgtcaccgtgcaggccaaattcttcagcagaagagctgaggagaagattaagagtgttgggggggcctgtgtcctggtggcttgaagccgcatggagggagtttcattaaatgctaactacttaaaaaaaaaaaaagaagaagaagaagaagaaaaatggaatactggaaatgtgagaccaaaatgagaaatcccagagcatattggtgtggtgataatgacccagcagacagggaaagcaggtgaaggagagagaggaggtaattgctgtgtgaagtctttgcggaggaaagagacaataggatatcaagaacgggtcttccctgggagcatgaatatttcacctcatccatttctacaggagtgaaggcaggatatgtaagttctgatatagttaagtggatagatcctgtagtggaagatgaagaatttcaattctgatagtctgtatttccaaaatgacatt

SEQ ID NO: 15438 - DNA, 1180 bp, Homo sapiens
gtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatac

SEQ ID NO: 15439 - DNA, 1161 bp, Homo sapiens
tgggctaatttcatattgtatgggagacattagatgcctcagttaattgagggtgtttttgcgtggagctcaatagatagttcaagtatattgtatttgaatcgcaatggtggaaatatagcacctggttgtcctgtgttctttgttccctaccctctcccccgacttccatccccacccctgtgggcagctatcattgttttgttttatttttctgcctttctcagaattagcctccaaatccttctcatagagcactccaggctcctttttgaccccatcattccaggcagggaccatcaattggatttgttgtttgcattgaaagtcatttgctgccccttcactaagtgattatttctgacatcacttctagcatttaattacctcaagtctatgaaataagctttcttttctgtaaatgaccagttgaggaagaaaactaagaggaatggaaagacttaacattattggaacacttttaaaaatagcacaaattttattgcccttgggtttttaaaactgcctttaacaatagctagatgtgtggctttggacaagttactgagcctctaaacatcgtttgttattagctaatctgaaggggtaaattttcattattaaagataatattagctaatactaaatggacacatgctctgtgacaggaactggaataattgtattacctgcacaatataatccttacgacagtcctataaggtacttattacttcactatttttctgaagagaaacccaagacacagatttaagttactttgcagactcactgtagtgaagatttaaacactgtgtaccagattcaaaaattagtgtgtaccatcagataaagtgcctgacatgatagaggctcaccagatattaggcaatgtatatgcagaaaaacataacccaaccagccatatgtttatagccacagttaaccactaaattgtttccattgttacaaacatatatcgggctatctccttttcctatggctaaataattaagtttgattttcttagatctccctttcttctttttctttttcttttttgttttctttcttgagatgggatctcgctctgtcatccaggctggagtgcagtggtgcgatcatagctcactgcagccttgaactcttcctgggctcaag

SEQ ID NO: 15440 - DNA, 1171 bp, Homo sapiens
tgcttattatctgcagtagtacagtacttcctctttttgtcctaaaatcatttctttcaagcttcaaggagcaccctgggtctcagtatttggaagcgatgattacatctgtattttctccattcggttcagcttgatcccagaggctctgatggtatctgctcagcctttgtcaagactgagcaggctaattttagtttagaaaatggaaatttttcaaaggaaacttcctccactagacaaattgtttttgacctgaggttttgatcagggtacagtggtcctcattgttgaaatgcaggaacacttcttgttgaccgctaacaaagggttaaacatcacgggcagtgttagaacaagttaaaaacagaacctatccaaagcatataacgtgcactccaaaataagccaggctcgctccttgttaatgggatcattgcagacatgccaaattctacaactagtcaattgtatacatatggtaaaacttttcataccattcaacatttgctgcaatatgattttaattacatacagattgggtagctggaagaaagcactggaattaaatagaagaaagttcaacacaagctcttttataagcggccctggtttaggttaggatgtatgcaaatgactgccagggacaggaagaggaatgtgtggtttggaggactctggggatgggacatgactcatcttcaacctgggaacacagttgtttatctggaagggagagtttacagaaacggtgattatattccttttgaagttgcaacttatgctgatgcttgcaccttgttacttacattcttccttcccaagtatagggtagtctctgcagacaaagttgctctctgggcaaaaattgcattcagttggaaaagtggtgggggttggatatgagagaatggtacttctgaaaatggtacttctgaaactcccccccctttattaggctgtgtttcttgtttctttgaagttaattttacataatgatttcaaacgtggtgctgtttattttatgcaagaaaagagctgggaagcacattttgtttcagattctgaaatggcgatggccgttgtgggagcgtggatgggcctttgccttttacagagggggaaaccgccactctggaatgtgctttcctcaaactttcatggcatatct

SEQ ID NO: 15441 - DNA, 1227 bp, Homo sapiens
tttaaaaaatggccctttgaaaactattaatcacgacttccccagccttactttttccacataacttaattattagaatgtaattttaaggatcctaaatcatttgatacctgctcaaagtggatataaactaagtaatttacagattctgaccagtttcatctaggtttctgatccacaataaattaaaataacttaaatctttacaaccattttgtgggaaaatgtatactgcacaaaacccaggaatgaacagtttttttttttttttttttttgcaatttccactttaccaccagtttaaaagtaaaatgaggaatttaacccatatctggattgaatcatactatgattttccgtggctctctgtttcataaaaacactcctcactgacaacagatgttaaactctggacactgaattctcgctctagaacagaatttaggtcgatggtggcattttcagactgactgtcaagggactggtgacggatctgcgccttgagcaaagttcctctgtccctcttggtgctgttggcttttcgtttaatggggcagaagtgcccccggaccagtttgggctgctctcctcctttctgaccctcacccgactccgggccaggctgctgctcagcctcggggtgaacgtctgggtcctcggaaatcctcagtctctggaactgaatttcgatgtctttagtagggctgccctgcttcacagtctgacggtggtcatcatcttcatcgctcaggatgtcactctctttgatgagattgtcggcaaaatctgccaagccggggtgtgggtatttcccgggagaagtgctcttggagtcctgcctgccctcagccgtggggcagccgctgctctgggtgccgctgctcaagctgccctcgtcagagtccagcaaggttcccttgccagtctcaccggtccactcgttgctggaggaattcttcaggacttttaaagacctggatgaagctacagtgagaaaaacacatttcgctgtgatacagaaacaggttacacaatgtgtaatgtttgcctcaaagcttgtgtaagatttaacattaagattttattttatgatatgacttcagttagcaactatcctggtaattaggcaaaaatgtagctactgaaaacatggacatttttgacttaggtttacagttgtaagttaggcaattcagcatttttagattaccagagctcaattatgta

SEQ ID NO: 15442 - DNA, 1164 bp, Homo sapiens
aagtcatgaagataaattagctgtcaccaatgaagttaatgattaatttggaaatgggtttttttcctcctgatgcttttgtcttttgactgattttcaatgctctgtaaatgatgagtgagagaagaggaggagggagagaatgtgtgtatgtttgtacatttggtacgtaagatttgtttcagtgcttttaagacagaagaatattaatttgccctatatattcaatttgaaataaaaatttccaatctgttatggtttaccttatatattatattcattgttattatcatgaaaatttaagctttagacttttctgaatgtatttaaagttatttgatcttattaatgaggtcaaattattattttttataacgtagacttatatttgaaacatagatgctgtatgaacctccttttgggggtttctgtgtatattgaaattggtgataagatttgcaaggaactttggttcattcagtagggagcccagttttaaattttacttttctttcagttaagtgaatttttgtcattgatatatgcaaagttcagatttgtgtagactttcggggtactgaatttgtttcctgttcattcagtcctaggaaggaatgtccttttctcctcttaggtcacacgtgacctttcccggtccctgtctgcagtctctttcctgcagggagctgtctccccttcatgtagccactgtccttgagctttaaccaagcatctgtaagcacctcacctggactcttaacgcctcacctgggaaatgattattgtaaactgttgttttggtaatactgtttggtagccagcattttaattttagtctattgtaaattgacacaaatatttgaatattttgttcattttgccattttacaaaaaatgagaaaggggaaattgagaggaacaatattagtgatgaaaatatctatatctgaaaaatgtaatgtaaagatatgaaacacttggggaagatgaatgcagaaaatctttagtctgaaattgactattcattaccccttagcaagaaagtaaatccccattgagcattatgttttagaatggaaaatgtaaattaagcctttgttttccatcatcattctcatcgtctttttcatgctctctggtggcagaaccccacccagctcccac

SEQ ID NO: 15443 - DNA, 1158 bp, Homo sapiens
cttacttgataatctctggatttcttcctgtttctcttggtgctgctactatcagctaactcgggatccttgcaaggcccacagaccccccagtcaactggcagcaattccatggcagaggttccaggtgacctgaagccacctaccccagcctccacccctcacggccagatgactccaatgcaaggtggaaggtatgttcaaataactctgtgaggcatacaaagtcacatttgttcatcttttagttttctggggcaaacttcacagagagaagaaatggtattccctagagagtttttaaatgttgatgactgccagttttcttcatgtcatttatcttgaatggtttttgcatttgcacatttcaagatgggttcatcttctgaatgtactgtttggaggtaactcctgctgtatcattaagctttcattctttgcctctcttcagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaaggtacgtgtagaggggcctccacccggccatggaccagtgggcattctactctctgccgttccacaacagttcacctttcactcagaacacctctgagcccatgctgcatcggtgtgggtcccaggtccccatcctactccacttgtggccttgggaaaagcagttagcctctttgtgccctcatcctgtccccggctggcctcagtgccctcagcctgttccctggcacatgctccctgtttccggatacctgccacctccttacacgtgccaagttacgttcctcatctagaaattgggaaaataataggacccgcttccaaaggcatggcgaggattaagttcctgcaacagagctcagagaagagtggctggcagccgcggtaagtaagcacgcacttcacggcacttggcatggtggtgtgctagtgtgcgctgggcgctagctcgtggattggtaaatcagagtcgctgcccaccttcagggaatcacagactccctgccttcttacttcctgggaggaagcaaaaaat

SEQ ID NO: 15444 - DNA, 1272 bp, Homo sapiens
tttgtttccttcagtagcaggaatagggaaaacaacaaattacttcccattctgtggctccagccatactcctgagaaatctgagccatcaaagtgctaatatttatcacagcatgttctgagggcaggagcacaggactagaggaaagcagcctgggaagccaaggccgtgtgtctgaggaggctgtcttggagttaaattttgcttccatgttctgcatacttggcggccttccaggacgccaccttgagacactcgtgagtggtgaagccaaaagaagacaaataccacttttgggtttgactcatttattaaaagctctgataccacattgcagactctgtagggtggctgaaagaaataacccggccatgagaaaggaccatctgtgctcaaccactccacctccagaagcactttcggcccctgcgtgaccaacaaagcgagatctgaaaccacaaaagtttctcgttacagctatggcctccatttaaaatcggaaatgatcacgcttaactgtccttgagagcatttgtttaaagtcaatatttaacttaacactccacttattttttcttactctttcgttaactttcgttctttcatgcatagagtcaacattcatgatatccttgttcttccccatcttcagttactcctgaggcgtggcgtgtgatgatgtcccttaaatcaggtcttttggctgagagtacgtgggctttggacactattaatattcttctgtatgatgacagcactgttgctactttcaatctctcccaggtaagccagcatagtccaactaacaaccaaattaggataggagagcatcaggccatgcacatttgtgcttgaactaatgcctgagttgatgagcactgaccgtccaacactgttaatcactgcagttgttatcaaccagccttaatcaatgtagagttatctgggataatattcactgtagtctttagtgtgtgtacacacacatacctctatttcttatgagagaacagtgactgtgtgtgtatgtgtatatgggatagatgacagtagtaacattaaattgttcagaatgaatattagctggccaatgggaagaaatcaaaatgtaacattaagttgtgactggagtcagcattggaaacacagttggttgcaatgggacataaccctgctttccaggaggacttgacatcttcttttcattaaaaagatattcaagatttagaaattttatattctatacatttatagaatgtataaatatatat

SEQ ID NO: 15445 - DNA, 1168 bp, Homo sapiens
gttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatgg

SEQ ID NO: 15446 - DNA, 1236 bp, Homo sapiens
caattacagactaagttagcatattcttttgaaaatataattgtactggggagaaaggggggattaaggacctactgatctcttgcataaaactggcctgatattcaatagattgactagacagaaatggagaggaagtgaatatttttgtaccatggttactgactctgtgaggaattggatatccgtgatctgagcagcccaaatcacttaagatagggatacaagttctttcctcaggggacagttatcaggactggctgcataatttgtggggccacagcataatgaaaatgcagggcccctcactgaaaaattattgagaatttcaagacagcagaagagaagtaaactaagtatggggccttttattcttgaggccctgtgaactgtataggcccatgacactggccctgacaattgtttttttcacagatagttgttgcttgcaattggaataatcaggaaatttcaaaagaagtgtaatctgagctttcttgaaagacaggtacattttccagttttcaaggaggaaggatggcatgaatcaagacacaacaaggaagcagttcaggctgcatttccctgacatcggctagaccatgtttactggcacagaagttgtcatgtgggaataagtctagaaggatggctagaggacagattatgacattgggaggccatgggaaaccattaaaaattatcttagtaatgtttttggaagatttggcagtggcatataggatgctttggggcaggctcactctagaggaagaccagttaaaaggctcttatgtagttgaaggcattcattcgcccagtggttatagccacactattctgaaaaatttcctcccttcccttctccaagaacttggaactgttaaataacatttactggaagccattggtttggactgagctcctgcactaggcctgagagaccaaaccaaaatggaacgactcatgctgaagtttcatgccaccaagccaaaactacattgtttatctgaccttctaaaaaatcaggagagagagagagagataatagcaatttcccaaacaggccagttttagctggcacagtaaggaagttccttctgcttgaatctttacaaggaaagtaactttgaaaggaccagtgcgcgttttgttctctgatactgctttcctcaccccttttctgtctggaaagccaaagtcctctgctgtatagcatattctatagtgtaccat

SEQ ID NO: 15447 - DNA, 1288 bp, Homo sapiens
cactccaccctgggcgacagagtgagactgtctccaaaaaaaacaaaaacaaaaacaaaaaaaacaaaaaaccaaaacccgaaactcaagaggaattactaaataaccagtaattacatttgatccagaacagaaggtagccaaagatattctaaggttctcttcatatctgaaaagaaataaacccaatttaaaaaaagacaaaaacatttaataggtatcatgtacaatttcagtacaaattttcacttcaaaaatattacaggattttattaatcactagtcccccaataatctttgcagctttccttcccaatgaaatgacttcattataaagtgaacgctttgatacattactttgtttatacttacacacacatcagggagaattttattatgtgccttgaacttcaacaacgttaaaccgttacaggaattgcttaagctgatgtcctaattcaatcattaaccaaaacatattttaagaataggcaagaagtctgagaagatggtgatgtaaaagggactaggcttggggtcagagagacaatggtgagttgtgaagtacctaaaccagtctgcgtgaactgcaccatgttagagaacagcaggaacaaaataggctacaaggtcacaataagaagccctggatggtagcatcaaagacgaaacatttaaaaaaccacagaatgaaatcccccaagatggcagctgctcattgtcaagattatttaatcaaccctgctgctgacctgggaatcctaccaactagtaagcattgattttaaaaataaataaggcaattccaattgtccttttttttttttttaagagaattctggtatgagaaccatacctactaccaactccaaatccaatctatgttgttcactaaatttgacagccacgatcaaataatatttaactcttaaactcctcgtaacttttttgtgattcacctcccccagtcaacacaattctgtgtgtttttacttacggtcagactctgaagagctacttaggagatgagcacatattttaacaaaaattttattctctgtcccatttatttggtatctggaacgaagagaaaacctaaaaatgagatctatttccagcactgcaagcaactttggaggagcttacttttcccctgcttctttgactggttgttacatttatctgttttcaaatttatctcctttttggtgagaaaagaggttatagggaaaagagcatttgaatgaattcttcaatttcatttcatttatgactctggctgttaata

SEQ ID NO: 15448 - DNA, 2011 bp, Homo sapiens
cattcagtgcagtcagtagctccatttgatgtaagtgtaaagatgggtctctcatttcagtttcagcaattattcttaaaacctttattttccagtgttttaaagtttttaaattttatatctttttttttttttaaacagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgagaaggtgactgagaaagaagtgtgatttcaaacattgcagcggctcacacagtgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaa

SEQ ID NO: 15449 - DNA, 1163 bp, Homo sapiens
cctggccccggtctgaggtcctttcttaagatactcctcacaactccgtgaggggtgtgctaccatggcttgcgtcaagcagacgaggaaaggggcagcaagagggtcctggtggccacagctgtgcagctggtgagtgaatgacgaggcccggagtcagagccaggcagccagactccagagcccgccttcctcaccactgacctcccggtgacatctctgggggcagcagtctgcagaaccattgttctagttgaatttcttccagcctccttttcagggtgcttttggttcgttaaaatgaccacatgtgtctacaattaaattggcaatcactttgtttttcttgcacaattgtagttgttgctggttcacttaataaattgcagaataagaagaacagagtggtgataatcacagggatttcttccttgagctgtgtgtatttagtgttcattcaaattacatttgttttaggttgagagaaatccttctgaatagtgatgacattggttgttccctgagatggcttcttgtgtaaatctatcaacaccctttggagggctcctgactcagaagatgaacgtccttgggatgggcaaagtgatgcttgttttgccttccctaaaagtagttctaggtgtaagaagtgatgtgactgacttagggccttagattatggcccaaatgtaggctttctgcagttctgccctatgtttttttgtgtagattttcctgcctttaataacttcactgataatagtaacactctaaaatgagagaacatgtcttatattggagagggtaataggttggtatctttttgaaccatcaaaggcctaggtcaaaactaaccctttcctctgacttcttagtcaaagaacatacactttagctaataccccaagacagaagttctttggtgctgagagtcaacgagagtcacattctccttgaaaagggaagggaagctctatacctggataactgcgcagatccatggccccatagcacaaaattcgggcaactgagaacccagctggcccccagctggtaattcctcaacattctggtgtgtcctaacattgccaaataggctggaaggatttagagaacaggaagtaagctactgggagataaggctgcagctgtgaattatagac

SEQ ID NO: 15450 - DNA, 1105 bp, Homo sapiens
tccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtaagacctcagaccaggtggcgctgcgagcccaggaggcgagggtttcagtgcttcggccttcaaggagcatttttcaaaaggccaaatgggaaatgtggaaaacaacgaacacctcttaggtggagctcatggggttatggtttttagtgtgcccactgctgtcttgtatttttttttttctttttgagaccgtctcgctctgtggcccaggctggagtgcagtggcgcagtcttggcttcctgcaagctacgcctcctgggttcacgccattctcccgcctcagcctcccgagtagctgggactacacgtgcccgccaccatgcccggctaattttttttttttttttgtatttttagtagagatggggtttcaccgtgttagccaggatgatctcgatctcctgacctcgtgatctgcccgccttggcctctcaaagtgcagggattacaggcgtgagctaccacgcccagccctaatttttttttttttagaaatgggagtctcactgtgttgtctagattggtctca

SEQ ID NO: 15451 - DNA, 1204 bp, Homo sapiens
tgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctg

SEQ ID NO: 15452 - DNA, 1219 bp, Homo sapiens
ctccctgccactccggaaggggataacaaagcagaagagacctggcttttaattctaaaggacaaaaggaagggctcttgtcaacagtggagcacacgtatcctcacatctgcacttggtgctgtgcacacagcctttgctttgactcggagtggagggtggagagagcaggatggagaggaaagagggctccatgtagagagtgacaggttaaaaggagagaaagaagaatgtgtaattcactctgttcattattataacaatcgcaaaattgggccagggaggacaaattaggccgcggcatctgcattgacgtgtcttagcttacgtttcccctgtgctctagtgttatatatttatggaaatgtcaggcttgcgttgcactgttaactttcttacacggtgacttattttcagtcatccaaagtagaaagattctaattggtgtaaatcatatattatgtttccaaaaatacccatttggttcattctttctaggaactgtgtttggctggcatctgactttctctgggcttttggcgagttccctggagacaatgagttctgcccatctgctgttgaaacgtgttacttcatgggttatttggcgggagcgtgagtctcgctttctttaaaggcaaatctttctgtgtatttgcagaaatgtgcggagattattgtggctcaccttggctacctgaactacactcagtatacagtgatagtgggatttgaacacctgaagctccccatcaagggaatgaacttcacagtaagtataccagctgactgcacgtttccatggctcatgttctagttcccattctttgttcaatgattgaaatacatctcagcatctaaataatgttaatttggacagtggaggacttgtaaagtttttaaaaattataggaaaactacagtttcttaagtatatagaactaagaatagcttaaatatcatagagattgggcaaaccttaggtgtctgagatttagaatagagagtatatagtgtgttcagctgcaaggcagtgaaggggttagcagacacagcacccccttctctggcccctgtgagtggtcgtcagtctctgcccgaactgccggtgagtgggagggcactgttctaattgttagactgtcctttcttgtgtccagctgaaatctcccctttccactcattaggagtcagtataaccagcatagtgatgaggagt

SEQ ID NO: 15453 - DNA, 2103 bp, Homo sapiens
tgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtg

SEQ ID NO: 15454 - DNA, 1099 bp, Homo sapiens
tagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgc

SEQ ID NO: 15455 - DNA, 1232 bp, Homo sapiens
atgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctttttttattgacatgttaactcctttccctcaattaatagaaatccactaagaaaatcattcacatattggttcactcaacaagcatttattaaatatatattcactattctagactaatagcaagaccggggatcttgtttaggaagaagcagtccctgttctccagaatttgcaaaaccattaaaaaagcacctactttaagccattttttttcagcaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagta

SEQ ID NO: 15456 - DNA, 1990 bp, Homo sapiens
ttgaattcattgttgcatgtggagggccaactgtatattattttaagtatctgacttcccccaaaacaaactcagtcatattttaagattccaagcaaaatttttaaatgtagtgtgattttagaattgtatttgtttacttgagcgtttattgactcccttgctttgtggcaggcactaaagaaacatttttcaatgttataaacgatattaaagttggtctgactctcctttgcacagaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttaattgagacagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttatttt

SEQ ID NO: 15457 - DNA, 1142 bp, Homo sapiens
ttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagg

SEQ ID NO: 15458 - DNA, 1938 bp, Homo sapiens
aatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaa

SEQ ID NO: 15459 - DNA, 1938 bp, Homo sapiens; identical to SEQ ID NO: 15458

SEQ ID NO: 15460 - DNA, 1084 bp, Homo sapiens
tgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaacgaccgactttcagaaagttgaagccataagtgggtcatttgtgctgtgtcagaaataagttacatattctgaatgcccagaagattgagcaagaagaaaaaacaaaagaagttacacatttaagaggggaaataagcttcttaggtacagattcagaaacaaaatttgtaagttgatagttacagctagtttgtacagtttaagtaggaaagaatttgagttcatttgacatagccccattgttttaaatgttggtattcacaagttttgagggcttatttttccttttatggcagtattcagacatcacacagatttttttatggtctctcaaaagtcttgtttcctcccccatcaccccttgagacttggaaagctctcaacttttctgattatttggaggataaaatgttaccaatctgggggagaaacaatgtttttatattattatttttaagag

SEQ ID NO: 15461 - DNA, 1188 bp, Homo sapiens
cagaaatagaactgtgaaggataactccctagacttgcacgtgggagtgaagaggccagttcctgctgtgcttgtgtcatcctgcgatgctggggttgacctgtttgtagtccactctggttgcggttaacaggaggggctgccttggagggttggcgtctggtgggtgtactaacttggtcagatgcagatgggctcctcatgggagccttttcacgggaagcatgaggtcacgttttctggctttcgtttgctggcatttgcttaagagaacatttggagtttgagaggagaatgactgaggatttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccactgcagcctgcaagaaagacatatttaaagcaaataaggaggtaacatgggaacttcaaattacatgcttatgaagtatactctggggaactttatctttcaaatactgattctaacctttccgggtgaaaatcttttttagcttccaaattgcatttgagcagagataccatgtgatttaatttttaaaacttttctgagtggttcttatttttaggacagggcatttaaaatatcacaggatgtgatttttggtccagattggaaatagaatggctcatccatatagggcaagttagttcttggtttctggtgctgtgcaactcagtaaactaagtgacgtgtttgggcttgggcttagagtattcactctacctgcaggagccatctgtttctgacgctgcctgcttcatcttcctttgcacctggctttccacctgtgttgtaccccgcttttgataagtctcctttacctgtttgcattgttaaatctctctgtccctctcctcagccttgggatgacttctggctgcaatgtgagtc

SEQ ID NO: 15462 - DNA, 1254 bp, Homo sapiens
tggatgtgtcagcagagatgttgtgggtgagctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtggagagggaaaacctggtgatgtaaagtgagaggagatgattgcacaacagtcctcatgtaagagagaagagataccgaaaagaacgcagaggagccaagacgtttattgacctttgcctgagttcgttattaggggacaccatagcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactccgatccggacacttctctattcatcaatgtttgtagagacataggtatgaatctttgtggggctgagggggtggtggtgagggatttcttctatggcttcaatatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctgggtgaaaaagaaaaagggatgatcaaggacttgggtacttggtcgggatgcatatttggcccaagctgacttgttcctttctctgtacttgccaaaactggtgtgagaagctttagcttaagctttagaatctttgataaattaactaaagaccgtaaataaatggtctttatctaaaaagggccatgaaaagttttactaagcctttgactagccttcagctggttttactaagccaagtttctaaaacccagcttgatgttcccctca

SEQ ID NO: 15463 - DNA, 1145 bp, Homo sapiens
tataacaaaaagcaagtgaactaagaagtaagcggcctcctgcttgggttgctaaacaggtttcgttaatttctgctttggatatgagacacattctcaccctttggctgtgtggctgtgctttcaaaagactttgtgtcttggggtagctgaagccctgacagtaggggacaatgtcagtttacagttggtgctgatgcatgttgcaagccatttggtctttcttgccctggaagggcattgtgcatccttcatggcgctttctggctgaacctatggatgaccctggaggaccccaatgtggctgttaatgtctagccaaacgtggcactctagggaaacccatccgctgccttggtgggttcagggggctggagaagggctgcacgtgctgggtttgggctgatttctttctttctttctctttctttcttttttttttaagtcacttctttgtctgcgtgatgatcatttttaaccacatcttctgttttctccccctttctcttccagataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtaaaaattttaaaaaagatgaaatcttttctggcttctgccagaggtcctgcattcttcatatctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcgctgtatcctcttcctcgggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttaccaagtcaaaatttttatggtaacaaatcttaatgtttctcaaagtgtagtattttgtaaatacttttctatgttt

SEQ ID NO: 15464 - DNA, 1158 bp, Homo sapiens
cttatttgagatactgaaaatactatcttaaattcattattgaggtggttttgctgaatgcaaaaccttcggaacacaagggaataaattatgtttgaaaaggctttcgtgtgaattctaggcaagaaacctctctgagggagaccttacaagaaggccataatatcatgctcgtcctactttgaacatgctgttgtttattagcccagcagttatgggctttgaatagcgctttaggctaacccagtagaagggaatggtggagttggatccatctccaaggaaaatgttagtaatcgcggttctggtggcctcaaggggcagcgtctcttctgcctcctccacttcttcctgccgttgggaacctcctgggaagaacctctccctttcaaactgtggggtgagaccactctgttaactgtcggactgaccttccatacttttattgtttttattctttcttagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaaggcaagtagcttctcagttctgtttcattcttaggcattatatgctaagaaatattattttcaggaataggtgtgttctcacttaatgtcattgctttatgacaagcatttaaatactgatgagacctggtctgaaaactgaaggatgttaggagtttaatttcccagagaaaggagcaggcccatccttgggaaagaagggtggattgaggttatgcctcactattgcgcattttgtgcttctcagtgcctagatatctctgtgcgtatttctgcattctgcgtaactgcagttcaaatgaagtgagttgtctaaaccagcggtgccaagaggagatttgggtcccagtgttcctgctgccgttggagaccttgtgtgggttcctgtggtctgcagcccgggcctggttctggtgactcctcacgtcgctcacgggccctcccttcagtgtggcagccttggagtgcttctgcccctcaggtctttgctgagagaaacgtgtgtttatttcagtgatgagaagacttggaacttgggtctgagta

SEQ ID NO: 15465 - DNA, 1505 bp, Homo sapiens
gacacagtgagctagccagtgttggatgttctggggtagtacttgatagcattgagtcacagggaatgcatttagtacgaggtttggctgtagaaattacagggcacgctgttggtcattcatgctgtttcagcagttgggcaagatttaaatacatttaggaacttgtaaaaatgaagtcaaagtagctggtggtgagtacgtggacagccctcaggcacagtggagaaagtgacattcccttaggtgatgaggctaaggaatgcctcatgtcatcatacacgggtcagtctgtgacgttgcagcagccttggacaaggggaagcctgattttattcccaaagtgtaatgtgacaggagtgcatggtatggtgctgggaggccagggatactttgtctcacactcttcagggtgtgtggtgtcacatgtcttaggctaagtttgacagcctagggacccgaaccaaaccttgtttaatgttctccttctttacaggtctcctgactcagaagctaacttatgaaaatggcttgttaaaaatgaacttcacggggggggacacttgccataaggtttatcagcgctccacagccatcttcttctactgtgaccgcggcacccagcgggtgagcatgtaccgacggccctcagcggggtcttctccccaccctcaggctgctgggatcatattagaaagaatctgtcctcagatctcatcaaatctcctggttaactgagtttaaaataaccatttacagaaaatatgttgaaactttcatcagttagtattgattttcatgaacgtaaccattctttactattttcattcttaaaactcaaagtataaactaaagttttgcattctcacttttatatatgtgcctcttaacttttttagccagtatttctaaaggagacttcagattgttcctacttgtttgagtggcgaacgcagtatgcctgcccacctttcgatctgactgaatgttcattcaagtaagtccatggatgtgttgtctcttttggacagactaacttggtatgattttgctttaataattagtggtcttgggtgcaggggattagattagtcagttaatttacctaggactcggtttgctcatattaaaatgaggagtcgggctaggttaactctcagctccgtcaccacctggagctgctgtggtgactgcatggggaagggattggagctgaagcagagagtggacccctggcactcttgcgtgatccacatgtcagtgagcagagtgggccaggagcggtgtggtgacccctgcgatgaagggaggtcttcgttgcatgtgatcgtccacagagctgctctcaacagctttgccagatcgccctctggacacctggggtcccatccttagagattttggttttgtgggtctgcggttctgttttttggagggatgccctgtgttctgccgtgtgaaacacccagtatgagccacttgatcactgttgactttcctggggg

SEQ ID NO: 15466 - DNA, 1182 bp, Homo sapiens
agaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccaggccaaccaataggcccatgctcatctccctggacaagcagacatgcactctcttcttctcctggcacacgccgctggcctgcgagcaagcggtgagttttcagatgggcacgggagaagtgcatgtccagtgcctggctgcacccgggccccttcgtcaggttcacttgcccactagtagatgcccagctgaactgtccactcctgatcaccccaataataaagttgactggaagtgcccagtgctatgtaatgaagcattttgacacctttctactttttttgttgttgttattcagcttttaaattcttatggatgacctagtggtgattaggaaaatttttttgtagactcaaagcagtctttcctacttaacagaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagtaagtatgacaaatccaagggtggagataatttttgcaagacttttagtgataacctttgcgttgtttcttgccttcagtggggagttgctcaagcataaaaaaaatggagaaagtaagtgggactgtgtatgttctgggtccgctactggaagattaaaggtttgcacattgaactgttcgctgatgatggtagccagccagtctttgagcatgggaggtaacacgaatatgtgtgtagggactctacttgtcatgagcctcagggttgacccaaatcaagaagtttttaggtgaagtgacaggaaagcacattgccctagcctggtttctttgtgtgaaatgccttgtcttctgtagttaaaacgcttgcgaaatgcaaacagtttctttggcaaggagttataattaagggcaagagtacgtttgctaat

SEQ ID NO: 15467 - DNA, 1128 bp, Homo sapiens
tgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccaggtaaatatttgcaatgaggtaaataaacttcaagctcatagtaaactagaaattagacatagcagcagaaagaagctgcggagtggagctccacggtcctatgagtgctgtaaccttgggcgtgaatgtgagctgttcctctgtacacccccggtgtgaatgctggtgtgtgaatcacgctgtgttctctcagttgcctggtgagttttggcaggtgaatgccggttgtcacgtaggtgctttaggatgggcagcttccttagggactgctgctgcattctgaggtgattgtgcctggcgaggcacagctgccacactgataatgttcttcttctttccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactgtgagtaggacggctccgcgtccccacatggcctggggccttgatactgtcaaggctcgattcacactgagacctttgtggatgccccagtcagtggcaggaattctcttgcataaaatattttcttactcgggctgtttcccacagagaaacgtttgaattgctctgtgggattgctgggtaaccgtatctacagaccgtggtagagctgccgtgagatgctgtgctgggtggctggctaggcccactcactagctggagggccttgtgtccacataccaggttttagccctggtggttcagattatgcctcaggaaaatgaatgtctgctatgggtcttcaggattctgaagctagtgaggattccggtaaaccaggcgactcatttattgactttccgccatgtggcagcccaggtggggatggaggtttcttggtgagccacactcagtgccttgcccctgcggtgctcagg

SEQ ID NO: 15468 - DNA, 1208 bp, Homo sapiens
aaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggacgtgggatgaagtctcttctgcctgattttaagtctttgcaaactttttagaccgtaaggagct

SEQ ID NO: 15469 - DNA, 2360 bp, Homo sapiens
ccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagtttagagtccagtgagtcaataaagcttttttttgtgcaacct

SEQ ID NO: 15470 - DNA, 1210 bp, Homo sapiens
tgctcctatacattctgttttctgtgtgtttcaaagacagaaagaggcgaggcactgaagttcagagcaggactgaacttgcccactcatcaattaagctgtcagcagctagcacataagtacatttttagttctgtctgatttgtatcttctagtccttcgctggtttttccttaaggcgtaagtttttagttctatatttcatttgtgttagaaagagctctataaacaagagaaacagaaagcataacagctctacccatgtggtactccttgttcatggtaggagaagcggcagtcacaattattactctcttcaagcaaaagaaaagttctccttttgagttttcacaggtaaaaatgaggaggagcacagtgctgaagagatttttctgtacaaaagttttacaaagaattatttaaaaaattataagtaaatttgaattcacttaactgtgttgctgaatattttccctgcacactgtctttcataggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgagtcttgtacttgaaaagaggtgtacatgagagggtatggcacttgattgattctttcaacaataaagttagcaatttcttttatttttaatttgattttaatgctcctgtaaagttcaatttttttttgaattattaccattagtattaataaaattgacacatagttttccagagatagaaacgtttgtcctgagtaatggttaaagccagcaatgcacgggcatttgaagaagtgaaagagggcaaatgtttcccagtgtactaatacaagatggcaactggttacatgggatagatggccttctattctttcagtctcttaggctgaagtttctagatttcctctgcccagaagtggtgtattggggatttgaggagagacagagccaggctgtcttcccctggattccctctgctctctgctggtgccccggggtgctatctttagtgtgtagggctctctttttcatactaagcacagtgaccccacacctaacaaccatgacagaacctgctttc

SEQ ID NO: 15471 - DNA, 1232 bp, Homo sapiens
ggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggaggtaggtttccagtaggtattaatacaatgatatccttagttccatttatttattgcaaattataatgttggtgttatgtactttcatattctaatatttttgaacacaaatggcagttataaattgcacatttaagcatttctgtaaagtactatgattaaatagatctatgaaaactgcatgaaatttagtgaattaagtgcagggtggtatgtggagggaataagttcaaccacgtaaatacaggatggcaaaggacaggctgggtataaacaaaaatggaaggaagaaagccatagtcatggatgaccacaagctgcatgtgagtcaggaaaaaagtccacgtcacactcaggtgtttataaatgaatagggcgcccaaggtcaaggagagagttctttctctatcctttgaagttgttttctctcttttgattagca

SEQ ID NO: 15472 - DNA, 1178 bp, Homo sapiens
acattagggatttgtaattaaataacaatttatgtcttagttatgaagtgcataacaatttatattgacctgagagtgcatataggcgttttagaaaatgctttcattagtcagttcccaggcttaactttagagcagtaacttacctctgccattgttcattacatttcttaagccttgccctctgtgcccagtacagtgctgggagcatcaggatgagtggatggggccttccccgtaagactcatactgcgcgtatgcacaagcacacacctggctctgcaagagctcagctctctcctgcttcctcacaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctcagttatattgtcttttaatggttaacacttatgagccaacgcagtatgatacagaagtctgtcattttcactcatctgttcctcaaaaggaggagcacaatcacgtgtgctaaagatggtcactgggttcggcgtctctttaggatcgcctcgctgaaaagcaaaggaaataaatgaagcaacactaatgacgtaaggtggttccttttaagtagtttctattaaccagcaagtttataacagatacaagtttaagccttgttatcacatgttgggagttcactttatttttaaaccaagatgtttaggtgctaggtcagtgtaattac

SEQ ID NO: 15473 - DNA, 1168 bp, Homo sapiens
aaatttattatcttgcagctcaatagtgcagaagtccacataggtcatacaggactaaaatcgaggtatctacagaaccgtgtcccctcctggggctctgctggaaagcctgtttcctggccttttccagctttcactccttggctcgtgggcctcttcaaagacaacttcttcaaagccagcaacgttgcatctccctgaccgtttttcgtgtcatctctagctgtcatcttgtgcctcactctgccagtttaaggaccatcgtgattatacttgatccacccagattatccaaaaggatctccctatctcgaggtctttaatgtgagcatgtgtgcaaagtaccttttgtcatgtaatgcaacatagtcacatagtcacgggttccaggaattaggttacgttcatcttggcggtggtgggcagaatattctgcctaccacacagtggagtggtcttcctaaaacacatctcttctcctactgacaattactaactactacctgtggagtaaagtccaaacttcctatttgggcataatggtctccatcctccgtcccgcgtccagtagtgcctacattcaagaaaccactggcatttgctccgtagcagtgtgactgcctctgtgtctactagttctgctctttgaccttgagtggccttaccttccctcagctctcgtgatcattcccaagtcaccacctctgcaaagcctcccaggacccaccctccgaggtggaacggcacactccttctaggtgcttgctgtccctacaaccacatctctcatgtcacctctccctcttcattgcaccttgctggttaccagcagagctccctgtgaacaggaaacttgtctgtcctgttgctgcatccccagcaccaggcatagtgaattacaaatgttagttggatgggcagatgaacgcacattaggctgcagagctcgtgggctgctcctggggcccatgcttgctctcacactaatataagaacagttatccagccagctgaggatgtcaacagccacttctcagaatgaaaaaggacacgaaccaatgtttcactttactacaccactagtgaattaaacgaagccacaagcactcggcttggaagattctatcattccttatgttctattccccaccgtttgggccacttagta

SEQ ID NO: 15474 - DNA, 1199 bp, Homo sapiens
cgccccctcctccctgcctccccggcggggcgggcgacgggggcaacgggagtgtgacggactgcggcgctcggcgggcctgggcgcaaggactgggtcgccgccgtgcggggcgcccggggcgggtgggtgtgggctgcggggccgacggccgcggggggggcgcggggctttccacggcacggggcgggtggggctgcgggcgcggtcggggctggcgcggcaggcgagaggaattccagcgggacgcgccagcgctgcctccgcctcgcctcccgttactatagttttttcagaacctcttatccaccccgcagaagagaaatttttttttaacgtcctgttgcttcacgggggactttcggggtgggcatcacgtggcccgacacgtagccgtggggctccagagcgcgtgcgcgcgtcgagcccggtcgccacgccccttccgagggtcgctccgcccccgtcgggccccgcgagcgcgcggtgggggaggggagggccccggagcgcgcctgcgtggggcgggggcggcagccgactaggggctgggtctggccgtttagggccgggtcttggcccgtcgcccacggtgcggagggctggtgggctttccttggccgtcgggcccgccacggcgcgggtcttggctgcggggcggaggtggggcgggagagccgaggataagagtttgaggcttttcgaggcgcgtgccgcggcgtccgcctctgcgggactctgcgccgggcgccctcggccggcgcgcccggctcccgctttgtcgccgagggaagcacgcgcgacgcccctcccgtcgccgccgtggcttctttcggtgttcgtgatttgctgagaggctggaaagcagcacggcggagaggagccttgcactcgccaggcgggaagcctgcgcggacacgcgtgcgcacccacggggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacaga

SEQ ID NO: 15475 - DNA, 1228 bp, Homo sapiens
agacttctgctgaacttgcagtctgttgtcttttgaacatctctgtttggatattccaaagatatctaaaaataatggaagtggtcccgtttaaatatccttcggacaaattagttctgaagtacaaaagaggctttggtattagttttgtctgacaggcattcttatagttgtttactgaagctatgatttggaatgactggcctcgtttagacttggaaaaattagatgaactaacaagtccatattataccggttaggaaggagctcgggctttgaagttaatttaataagatatgttatttgattcgtataaaaattggtttgtagtagaaattaattaaggctatagtcttgtttaaacatgggcttaatccagagaatgatagaataggccaggagctccttatttgagttttaatgctttatcaatgaaaccctcccctgccctctcttttttcctctggactagcaagaatattttttttgtctaacacatttaaaatttttacttttaacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagatgtaagtatattttgttgttttattcaattttgttctgcttcacatatgttgggaagagatatatttggtggtaaatacttaagcattattagccactttaaaaaaatgcagtcatcaactgaagtgtgaataatttggcatgataatttaaaaaatttctctctaaatatgtttgcatttgattgctgctatgtcactttggaaatgcacatggtatagactcttgggtttcaaaactggatgaggaattgtggaaagcactatggcctgactgacacagagcaccaagcacaacattgctcatctttaatctgaccttcaagaagccacagcttgggccacagcattctttctgtaaaatgaaggtgttggaccataagtttcctttcagctctaaaatttttattgaaaccactgattgtaatctgattttcccccatcttagtccattgttgaactattctctataagcatcttgttgtgaatagcctccttgtcctatatctgttaatttctaaataaatccagattctttgctttttgttacaaagccctatatgatac

SEQ ID NO: 15476 - DNA, 1065 bp, Homo sapiens
ttagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaa

SEQ ID NO: 15477 - DNA, 2425 bp, Homo sapiens
tgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaa

SEQ ID NO: 15478 - DNA, 1071 bp, Homo sapiens
aaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatt

SEQ ID NO: 15479 - DNA, 1244 bp, Homo sapiens
atcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatattt

SEQ ID NO: 15480 - DNA, 1225 bp, Homo sapiens
tttgttagtaatagaattgttgttttatttcaataggcttttgcgggaacaggcggtatttggttacatgaataaattttttcgtggtgatttctgagattttagtgtacttatcaccctaaaagtacatttttatatgtgtatttgtgtgtgaatgtggtttttatatgtatgaatgtatttactgatcatagagttgtttactaatgtaagcatttattcttaacctggtgtttttttttcaagcttatgatgtctttcggtagctgttaatttagagtagtctttggaaattgcttgctagagcttttcaaacacaccaagaggctaatatttcctctgttgagtgaaagtatgaattgggtaagctgtacacagtgattccttggcagatgttcctaaattacatgcatctttttgagaaagttttgcacagttgactgccagtcagcgggccatcctgaccaacctgagtctgcctgatgatttcccatgctgctgttctagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccaggtgagaaaactggtcacaccagcacacattattaatgtgcatttttagcttcaaatctttgtactttctaatgcatcttcaagtagtcttctgttggctgacttaacatttttagccatttatttttttaaaagtaactctcataacatttatttctcttaaattattaaaacttaaggttgtaaaatatgtatatgtttacataaaaatggttcacatggacaaagatgagtattcagaaaccaaatttagtgtatggacaattttaaattattttaatccctaaaatttttttttccaagataactttagtaaaatagttactctaccaacaatgacaaattggtatttacctagggcagatttcataaaggggtgggtgtgtgtgtgtgtgtgtgtgtgtgtgtgtgtgtgtgtgtgtggctgttgtttctgatgcatggacagtgtctaaaaagaatatctttaaattttatatctaagaaacccatcttagtaagaggaaggctatttgattttaaagtaacagactacatttattttcacatga

SEQ ID NO: 15481 - DNA, 1172 bp, Homo sapiens
aataggttaggatgttttctgactgtctccctctatcccgcttccttcacgtttagcatcattttaatgcttagcgtaggtaagtggaggtgtttttaaaataaatgggatgtccttttgggtttggcaatctttaataaattttaacgattatttgttttgtttacagatagttctcattttggtgtgtcatgctggccatactctttaaaaagtctcttaaggccaaactaatgatgttaagtgtaattagttaataactatatgtagtttaagatcatgtcactgtttcctcttggaatgaagttgatatttttaaagtaattaaacggcacttactaccataggtaccattatctaaatctgctgcacattcaaaggcttcttcctggatgacattttgctcctcttgtcctctcaccctgtctgggcagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggtgattgctggtgccactccccagctcatgtgctttatgataaaggcatctgatctttatgatgagcaagagcttcaatgcagcaaaacctcaataccctctttttggggtttttcgtatgtacaaataatgaagtagtgctatgtgagtacttgggctgcggttacaaagtacagattattttttcactgtattaattgtatgccataattgttactgttaagtacttaagcctgaataaatctaataaaatgattgcttatagataaataaaaattcagagttagaaatggtggtgacaccaagcaactgcagattgtttacatggtttgttttctgataatttaatgtacacaaactttgtttcatgcacaaagttatttcaaatattgtatgaaattaccttcagtctgtgtgtataaggtgtatatgaaacaaatttcatatttagacttgggtcccatccccagag

SEQ ID NO: 15482 - DNA, 1193 bp, Homo sapiens
gtgggtaatacatcaataaaacgtgtctaaataaaaatcacccataaaccaataatttagaaataacctctatatattgatatatttccaaactggcaaaaatactgggtagatatttgattccggtcttttatattttacattgtgtgggcttttccctatatcattaaacattctatacaaatatagttattaacagctgaaaattaaagaattgtgtgaggaaaaaaatgattagaaaagaaacttcttgtgattgaacaatttctttttatttaaagctacacgttacttaaaattagtaattaaaatcttggttcatctataaaatgtgtgcggcccagagttgctggctttagaaaactgatgatgggggtactcctgggacctgtgctccctccgtaaccctgcgtctgtctgtgtgtgtgtgtgtgtctgtgagataagctgtgctgcagtgagcagacagcctttgaatagttgttggtcacatgcaccaggcagtgagcatctctttttaattttgcgtttgttttccaaacaggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggtaaattagtctaaatgcctgagtctgagctacgccccaggttgaagcgagcattttattcattgtccatctcatagggtagtccacttgtgtgggagtgcaccctcgtgctgtctggagaagtccgtgttccactgacttggagaaatatttcatggtgatgtaaggtcagaagtgtcgagacacagagcccttgggcatgttttgtgaccctgtagtgagcatctgctctgcgcacttgatgtcatggttacattttctgcctgggctgataacaaggaaccgtttattgttctcccttcttggtattttatgagcgtagtaggttgattcattcctttagcactaaattgtaaactttgttgataccagcatagcagttaagagcaacacaagctttggaagcagactgcctgcattctaaacccacctctgtcacctacaggctgt

SEQ ID NO: 15483 - DNA, 1191 bp, Homo sapiens
attaaaatgattgatagtatatatcatgcaggtagtttttagtttgcttacacttgtggctgttcagaactattcttaaattaacttcaggattccaagtctctattttactctcatcattaactgatgcatgaataactgatttttcatacttgtaattttcatgtaaaaatgagaaccaggactttgttgcagttatctgtgtacatgttgggtggttttatttttgttttactttcctgcatagtgcatttcttacaatatatcttcaatgcagtgttttcgccttgtttttgcaatagggtgctggtcaagataaactaggaatctatgtgaagtcggttgtgaaaggaggtgctgcagatgtggtcagtatcattttgaaagaagtacattttcagtgtgtcatatattcagcaaatgatgtgagagattctgctgatacttctagttatgtagcactatagtgcttgttggaagaacaaatagagtatctactcatcattaccttttcttcctcccgctctctttgctctctacccctaatccatgcacacacctgtggatttgcctaggatggacgtctagctgcaggtgatcagctcctcagtgtggatggacgaagtctggttggactctctcaggaaaggtatcattgatttatttgcttgaagcatagtattagcatttttaggtgatttttgcattaaatgttgaaattggaagataaaaactatgctaaaacgtgctcatattactctttaccttttatagtgtacgtgacatttcacttgttatcaaattataaatatatattttaatctagtacagtttctttgaaacttgaaagaaacatactcaacacttctttaaatttctgaatattatcttactattcttaaaatgataacaggagatgtgtttgcctattttcatagtcagttttcaaaggagaaaatgggtagtgagtaagctgtctggaagtcagaaccattactcaaaataatagatgaagctgtgtaacatgattttccattgctataatcacagcgattcatgacagagcaggcactgcgttttagtctttcttacatgtgtaatcttcttctcctagggcggcagaactcatgacaagaacaagctctgtggtgacactggaagtagcaaagcagggtgccatctaccacggtc

SEQ ID NO: 15484 - DNA, 2246 bp, Homo sapiens
ccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatgatttctgtgtcaggcagtggttttcatttgtggggacgtgtcgtgtgcctcgtcacacagctcacgggtggtgtctgagtctcataagccgttctgctgcccaggccttcctgatgcttccttgatcccagcaagcttaggtgggcattcgagccatttctcagtgacactgtctcttggtggcccctttgaaataaaatatccgtagtaataagtaaatggtgtacataaggcatcctggtgagaagcgtcctagtgcaagaacccactcgggacggcctcgtgtaaaagggtgtgtttgattgtaaaactacacaagtcacattgtgaggacctgggagctgcgggag

SEQ ID NO: 15485 - DNA, 1149 bp, Homo sapiens
ttacaggtgtgagccaccacgcctggctgtgtttcatttactgctatcattcagcatcactcttcattattgatattttctatggctcataaactgatttaaaagcaaaatgggaaaggtgaatttcctgaggaaaattttagaaaaaatcattttatagtcaagtttgggatttttaccattgtttcttgatctaaggaatagagttagctatatgagccgtatctgaatttgagaaaggctattcctcatgaactagtttagtatagttatttatatgaccttcttgctttggattattctatttcctattttattctaacttttgtatcttgctgagttttatttcttgaatttataaatttttttgtagcccctttaataatatttggaatatgtaatatgaatactttaaaaagtcaaggtttttaagcttttaaaagttttacaagtgcataaggttttgctgtttttaatagtcttttgatcttttttttggagatttagagcgacgagatttgtctcacaaggagaaactctacctgagagagctaaatgtcattactgaaactcagtgcactctaggtaagaatagctttttaatgtgaatttttcaagctgaacatttatgagataatactagataagtatcttatttcctaaaatattttacaaaattaataaaataaattgaactatttaaatgctacattatttacttcatttttgattattgttaaaatacacaggagaatgaagcttgaacacacatgtggttcctgacttatgatggttcagcttcatgatggtgtgaaagcaatgcatattcagtagaaaccatacttcaagtgtctatacaaccattattcttttcacttgcagtataatatgtaacaagtcacatgacatattcaacactttatattaaaatttgtgttagctgattttgcccagctgtaggctaatgtaagttttctgagcatgtttaagttaggctagggtaagcaaagatgtttggtaggctagatgtattaaatgcttttactttttaggatagtttcaacttaggatgggtttatcatatgtaaccccattgcaagtcaaggatcaacctctattctataacagagtataattgtctaatttttc

SEQ ID NO: 15486 - DNA, 1285 bp, Homo sapiens
ttcatgcagaaattcctattttgaggtagtttaacttataaattattttactgcatttggatttttcagttttaatttaaaaaatcatggaatttgtccatgatttctgttagtatttttatggctttactgataacatttaaatattttatctatttgaaatttatttttatatacatggtgggacatgggtgcaactttcatcttttattatttattttgctgaatgctactcagttgtcctaatgccatttatcacatagtttttttcactaacaactttagatgtcacttttatgacttactaatttccctcctatttttgtgtctatctgtatttcctgtgcttttctgttgttctgtgtgtttattcatgacccagtacaacaatgttttagttattaaaactattatatgatctaagaactggtaaggctaattttctctttactctttttttttctggattttcctatttttgtttgcttctttttctatttgaatgttagaatcagattgtctagttctcacctcacagtaaaataaattaacaaataaataaaatacaaagatccagaaaaacctcagtctatttttatttaggtgcattcatttacataataagtcagggaaagttggcattttatgatgttgagtcttcctagtcgagaacatcataagtctttctatttgtccaagttttcttttataaactttcgagggtggataaaaatgtatctcatatagatgttaactttcttgttaagtttattcctgggaactttttcttgctaattaaatgggagtaatttcttttgttatatcttctaaagctattggtttctgtatatcaattttatccctacatcttactaattttcttattatttgttgaagaaattaacttgatattgtcttttggtttgagataggtgtatcttaccatgttatgaaaatacttatcaaatcctattttattaagttttttaacgctaaatttcatcagatacgaaatgcagcttttatacagattatcttattttttttaaatcttggatctgttcagaggaattacccataatcagcttttgcaaatattttctaaagtttttgaatttgattttcacatacaaatgtgtttggttgttgtttacagcatgtgtcattcaaaacccaatttttcataaggatgccatgttttcctaagcatttggagttccacagcatcttgaattcgtttaacaaaatgttatagaagaaaaaacttagaattagtacagttgtg

SEQ ID NO: 15487 - DNA, 1194 bp, Homo sapiens
ctgctcagttttctgaaggatgtcatatatagctactcctctgcttattgcttattgacctcatctcctgtcaccccactacacccagaccctaactctgcttttctcagaaaagatgtgcttttcctaactccgtcccacatcttcagtctggaatgttctgtgctcttcagtgtagccttcagcgctcacctacttaaaagtcctttctgctgaagcctgtcttcttctaggagacttagtggacatctgttggggctctcctggctcttattttcttcttagttatagcaattctctgatcactttgcttgcatacgtccacctctccgggtcatgtgcttctcaagagtgggagctttgccagggaatcgttgtcagatttctgatgtgtgtaattcatccaggtctggaagggtctttattcagtctgaaggacattttaattttgtgtagtattttcatcacaaatcctcgtacacatgagggtattggaagaaacttgaacctttcctttgtgctcactgtcacatgacatctcacccaagtttcatgtcccaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactcattttgctataacttgtcttctctaagcaggacagatataggaagtagaatttcttttaattttcttcatttttcccacccttttctatttttctgagattttttttttttttttttttttttttttgcattttaagtaatgaaaacaggtcatgttaattttcccttacactaatgaggtaggaatttctctgtaaaagttgaccttttgagcaaacttatcttatgaagagggctctggtgtttacgcagccagcttgcctgaagggacctttaaaccatccagaagggagagtatttactagggttttattaagactctaatggttataaatgaaata

SEQ ID NO: 15488 - DNA, 1214 bp, Homo sapiens
ttcagttctgccactcccagttcatgcactgttgtcacatggctctttccgcagttgtttcttagtgggacttcagcacgccttgattttcccttctgtagttcattgtggcgtaatcatatgttatactgcttgttttctttgtactttttattatcagtgaggttgtgagctctttaaggataggaaatgttatatacattttttattagccaggacaattaacgttcccaccgttattcgagttgccgttgcgccatagttctgacaatttttttgtatggtcagacttaaatttttgtccattggggtgaattccaatgttttcttcgagggggaaaaaaacaaaaaacaaacaaaaaaaaccctttacatccctgtcagcgctttttggaatgggcgggattcaactaccaaagggacaagccgccgtgcagccctccaggagcaacgactagcgtgagatagagaggccgggagcgaacttcaggagaagccggaagtggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggagggtaaaaaccccagagagctgcggctttcactttcgcccttcccccatctgctgaagcctatttaggagtcaccgccgtgatggcgctgccccgggctcctgcaggcctcagaaccctgagctgagggggtccgcacaaggccggtctccctgccgtcctctcatgccctgtgtttccctcttcaggctcgctttgctcaagtttacttggtgattgcgatacagccttggtttttagggtttcccattacagtcatgtcatttgagtttttatgtggaccgccactccgtgctccttgctgctgtaagacagtaaagtagaaattgaaacatagcctctgctctgtggaagaccattaaaactggacctcatgtacacgtttcttatgccagccggcgagggtagagggttagcgtctgaaacttaaaagttagggttgtttggtctgtgttgttagatgcatagctgggttggtagccgagatgtctaattgtagccgcctgatttctgttatttctaattgt

SEQ ID NO: 15489 - DNA, 1174 bp, Homo sapiens
tcagcataggtctgcctgggtgcagactcttctgtctggctggtggcctccatcctcagggttgtctcatggcccaaggtggctgccagagctccagaaatcacatctaagccctaggctggaagaaaggaaggcagagagaagggcaaatgagccattcttggcctcagtttcccccatctgtacaatgggagaatggggcttggtctctagacatgttctgtgagatgctgtgagcctaatcccaattcctgtcagggtactgcaacatggccaatgtggcaaatgtgattctggaaatttcttgaaaacttgaaatccctgtgtgcccctgattgggttaaatgttttcaccctgttttcctcctatgcagccatgtgtgtgctgggtggttcacttggtcggtggtctcagtgtctgtctttcccttctccctgcagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgtttttttttttttttttttacaccataaagtgattattaagctttcctttttactctttggctagctttttttttttttttttttttttaattatctcttggatgacatttacaccg

SEQ ID NO: 15490 - DNA, 1107 bp, Homo sapiens
cgcaatcctcccacctcagactcctgcgtagctgggaccacaggcatgcaccacggcacctggctaatcttcctgttttttatagagatggggtctttgccatgttgcccaggctggtcttgacttcctgggctctagtgatccacctgccttggcctccacagggctaggactgcagccgtgcaccgcctctgtgaatgttctgaacgacggggcatttgtcagctttgcgtccaccccaagacttgttttgaaatggtgaggttgaaactcacaggtgtcccttaaatgtgatgtgcggtaacttgagttgttgaggttttgcttgtgaatttctcattcttctttccctttttcgttccagagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagtgtaagtggccgtattccagtcgtggtcgcggagctgtaactcgagcttaagatcccgcctctgtggtgtgcggggcccgaggctgtactgtagccaagacagcgttcccctcacccccgggccgcaggccctccccacacccagcccctgggaacaactgatctcctttctgtgcccgtaggtaacagcgtgttgagggtgaacccttcatgctcattttcaagcacactcgggggtgcagtgccaggtgcatgttgtgtagacgtgttgtgtagacgtgccgtgcaccagacagacagggcccgggctgctgacacaggaccgagatgcccagcgttcagcattgacatctggactgtcctgagggcccttccaggcctcgcaggggctgtgggagcacccagacgggggatgatggcacagcttcgggtgtcctgcgagtggtgtccctggtgcagtcctctttctcactccctgtccacactcggctgctggttatcgcctcgtcac

SEQ ID NO: 15491 - DNA, 1277 bp, Homo sapiens
gacatagtctcactttgtcacccaggctggagtgcagtggcacgatctcggctcactgcaacctccacctcccaggttcaagtgattctcctgcctcagcctcccaagtagatgggactacaggtatatgccaccatgctagggtaatttttgtatttttagtggagatggggtttcaccatgttgaccaggctggtctcaaactctggacctcaggtgatcctccctccttggcctcccaaagtgctgggattataggcatgagccaccatgcctgaccaaataggttttcatatggaaaaacgtgattttggggggttaaaattttctgctgcttttctgtgataatcaccttactgattgagaaagaggaagcggggaggtggtggccgatagtgccctctcccaggtgggagcgcctgagcctgggcctgtgctggatggggcctcctcccgtctcctgagggccgtgcacaggagcctctgttgtgtcttacaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggtaggtccgggctctgcctctgcacggcccccagctggggcctgggccaggggtccccatctccctccccaacagctcactgagcaagggggttcccacctccttccccaacactgcactgcgcaaggggttccccatctccctcccccacactgagtcaaaggtgggccgggggtccccacctccctcccccacgccgagtctaaggtgggccgggggtccccacctccctcccccacagcactctgggtgagggttccccacaccaagtctgaggtgggcgtgtgcagtgacccctgagcttaactggcctggaagcagctagtccatcctcactgggtaaacacaagctctcggcagggaatgcacagagaagcactaagtcaaagtcatctccgtgtggtcattaaaattccagtgaatgaaaaagttttagggaacattaactgttaatggcttatgtattagctgttctctgttttaaaagcctttgggcacttttcaaacctaacaaacaactgattgaatttctattgatggtcaaagtggtaaaaatacctctttgttatctaagacaacttttaggtggcattaagaccccgagggtctagggcctccaggtgtacggct

SEQ ID NO: 15492 - DNA, 1208 bp, Homo sapiens
tgagagtggttaccaggcaacagagaggcatctgctgctgctgaggcttgtgccttgctgagcgggctgtgagaagatagatgggctttcctctccttccctcatgttctgctttcctccttaggccaggtgctgtgtgtgctgccgtctgtctgtattttcttcaaggataagctttcaccttcagtcagaagatggtatctgcatatatctggaggcattttaggaaataaactgtgaccagtgccataatgctgatttattaaccattgtaacctttacattttttaatgggttttgttcttatttgataagctgagctcaacagcaaaaatgtgtgtgtgtgtgtgtttttttttttaggtcttgatgatgatggtgatcttaaaggtaattattttagtccttttatcttcatatacttttcaaaatagaagttttagttaaatatctgcagactgtgataaacaggttccatctactgtttgaaaactttaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgcacacctttatttttataaaacggcacagatgttcacacatactgaaggagtggctttgggacgctgctctggtctgtcctgtgaagagtggttatgccagtgttcgtgtcgggaaaacatttcccgtggtcgctagccctgtgcttatggtgatggaggggccttcagagaacctgtaggtctgggaaggacacacgtgactctggtttgttctgggacagcagcagtcactg

SEQ ID NO: 15493 - DNA, 2318 bp, Homo sapiens
gcttgcagtgagctgagatcgtgccattgtactccagcctgggtgacagggcaagactctgtctcaacaacaacaacaaaaggttaatttccaactcagctgcttcctgtcagacgtcatatttggggaagtgattggacttggggttattaatatgaaatacatgtgtgtgtttttcccaccttgatttcagaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtctatttcttttctcagtttgtctgtttctgcccctgggatgtgggagggactgggtttgctggttcttgttggcaagctctgtagcacagcctttgaatggtaacctgtcctccaaggccttgaggcctcaagtgtgccaggcacctctttctgtagggcaccatttccacttggaaaacggactgaattacaagttgcttgatgggcagaacattaggaaaactgatgcctttcctcaggacacagttttcatcgctgcttctgtagctgaaggcaggtgctggcaccaggtcacagacgatagcacacacaccacactattttgcacctggcttttccccagttaccaagtgtgtcccgtaagaacctttttttttttaacagctgtttttgtccattgtatgcacggctggatcatg

SEQ ID NO: 15494 - DNA, 1142 bp, Homo sapiens
tgtgattcgtaggcagggcatgactggggccctgtcctctccactgctccgatggacagtggcctccccgccagctggcaaggtggggcaccactttggcttgtcggcctgtcctgtcgggtgacgtgcggttggcagagcccttctgtgagctgcctggctgcaagtcccactcctagtccctgctgctctgggagatgccccgggccagagccaggtacccagagcggccacagctgttcctggactccagctccccacggcaccttccccagcccccgcctcggccagggcgtccgtccttccttcctcgctgtgctctggggcatatggcgctggaactgcggtgggcagctcagtgtggtggtccacggctcactcagggacgcccagcaggttcctctccctgttaagtagttgcgaatggaaatccacttctgtggggaatgtgggacagagagccggagtggccgtgcgttcctctgatgagggtctgtgctgtttgcagaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaaggtaggcctggggccagggcaggcgtgggcacctctctgctctcggcgttgatttgcactgtgcgttccaatacatcagggtcacccaccagggcagagatggggtttcaccctgtggtcacgcgggccggtccatggagacccatgcgccatgctaagcccgggatcagagccactgcacccgagaagctgcgagaaggggggcaggcggccgcctctccaggccttcccgtgggacgttctgaccctcagggaggcagccgtgccttcacggggcctatgcgtgctgctgctcctttctggaacattctttccagcgctgggatggtgctgtgccctgtttttctcctttacgctgacctcatcttctgatgaagcctttgcggggattaatcaccctgtggtggggtctggctgtctgcgtggtgtggttggtgtttttagttccaggtctgcagctctgaggcgggagtggtgctgggtag

SEQ ID NO: 15495 - DNA, 1151 bp, Homo sapiens
ggagggagtgtgagcgggtgttaggacgggcttgggagtggtgtgtgttcatgagatgttgagggttggttgttgggtcagtgtggtgagaacatcaggctggtttctgctgttgatctacatccgaggtgcactggcctgggccctgattatattgcgccctgtaagttgcttctggtaggtgagaagggtcacatggtaacactaattggttatcacaacgaacattagtgcagttggattaagcagctccaagagcttggagaatcaagatgttgcatagctgagtgacttttccccgtggatctgttgatttggtgctgcgtgtgaggcctgggctggctctgagtccctatcaggacctctgcctgtgggctctggctgggctctcctccagggcgggcaggtgggctagaattaacatggagtgtctttccccctttccttttctgtgttatattcgtgaaatgtatttacatttttctgtctttcctttgcagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtaggtgtctgtggctcttcgggtctcggcttccattgctgccttggctgggcagccttagaacaggtccccttgtcccctgtccgagccgagctgcaggataaactgagttcactctgggcagagcccacagtgcacttgtcagcctgacccatgatttttcataagtttaaccaatgttaagaagtattttagaaactccccctttcccgacgggcactggagtgccctacacacgcccctcgcctctcgcccactgccgggaggccctgtggtctctgctgtactcaggcctgcctcggccagttctttcccgcactatctggaaatgcgtggaattgtgagcatctaccccgcggcccctcccgccagctcgctggggcgtcctgcaggccaggctccgggcgctgtctgctcctgcgtggtcccttccgccagctcgggcgctgtctgctcctgcgtggtccctcccgccagctcgctggggcgtcctgcaggccaggctccgggcg

SEQ ID NO: 15496 - DNA, 1178 bp, Homo sapiens
cgtgcagccttcgctgccgcctcgcacgcacagcggcctttacttgcgtgaccgcctgacccaggcacgctgcacacgcacagcggcctttacacgcgtgaccgcctgaccctggcacgctgctttcacgtaacacccccatgctctcagatggaggctaggccaacattggggaagggggtcgccctgcatcctccctgccatccttgcacacccctctgcgcggggcacccggtttgatgtgtacagaagctgaggttgcaggtctcgcctgaggtctggctgttggagccggggatcctgcaggcctcaccacctcctgatggagagcctggtggtccctgggcaggctctggacacctttgttctctggggcagctcctgggtgttggggtccctcactgcttcacatcacaggtctcaagggccctgggcccctcaggccacaaggtgggggctacgaatgaacagggacacgatgggacgcggttctggcacggagctgcaccgggcgcttagcctctccgctgcgctcctcctccttctcctccgcttcctcctgacactggccttccccgttccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccaggtacttgggcgtgggcctcttgcgggggaggagggcagtgagggctctgcctcccgcaggacggcccgggtgtcctgtgactgctcctctgtgggtcttgggtctcagtttccaagtgagaaaggacagtgccccagggagtggcggcaggtcccctttttccagtgaacattcccccgggacgggaggtgggggcagtgcggcgtccgcctgtttgcaccacccaggctcggcgctcctgccttgctttccccatctgctggtacctaggactgtgttttacttggtgtctgtgtttactttttcctttgaaccgcgtgggagccctcaccagctggg

SEQ ID NO: 15497 - DNA, 1192 bp, Homo sapiens
gtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcaggtgagacacacggccagccagagagggcgggtgtccaagccccagggcaggggaggggtgggaggatgggcgggtgggaggcgctgcatggagccctctccttggtttgcagggagcagcccacacccctccctcacggaggaggaggacagccagacggagttgctgatcgcggaggagaagctgagccccgagcaggagggccagctcatgcccaggtagctgcgtgcctgcccggtcccagttgggggcggcgggggcgggcgcctcggggccaccttcctccctcctcgctccctcctctggcctaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaaggtgcgggggcgccccgggggggtgggcggggcagggggtgggggcaggctctgtgtggccccacagcgtggtcttcctgccggggtggccgtgagcccactgctccctcctcggccccgcagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcaggtgcgtggcgagccggggcagagcgggggtgcgggtggagtgggggtgtgggtgggggtgtgggcggagcgggggtgcgggcggagtgggggcacaggcggagtgggggcacaggcgtagcggggacagggtctgtaccctcacctcacccagggagctgctgagcgcgcacaaggacaacctgggcaccaccatcaagttggtgatcttcaatgagctctccagcgcccggaacccgaacaacatgcaggtcctctataccgcactg

SEQ ID NO: 15498 - DNA, 1156 bp, Homo sapiens
cgagcacgtgtggtttgggaggttgttctgtccagcgatatcctctttcagaacctgtgggtgcttccggagcagagcagggcaggctgtccactggggctggagcctgtcctctgctccctgctagcctcctggatccttgtctcctgctcccgcgcgcctcctgcagaacggcactgctttttgtctcgtgtacctgctccaggccaccagttagagttcactgctccccgctgggtcgcagccctcccaaccgctggctcagccaagcccgtgcacttgctctcttcctgagagacacatggaacgtgtcacctgtgtggcagtgctgttgcttggcccgactggggcgtctccccccagccctatgggggtgctcaaggcatggccctggagaccctggaggtcagtacagtggtgtcctgggggacacggtggcttcatgctcatgactcagtcgctcaaggcttgaatttactcatctgtaaaatcgagatgattaaaaatcatacttgtgggtgggtcttgatctatgttcctcagatagctaagaataaaggtgcttttagagattttgccaaggttcgaatacaattttattagtattttcctagtttcatgccagacgtcatcactgaggatcaccgtgcatgcggctgtgtttacatcttaacccttgaggccactggcaggctcaccgtgctgcgagctcaccatgtcgtaaccatctcgggctcaccatgccgcgggctcaccaagtcgtaactctgtcttgggctcaccatgccgcgggctcaccaagtcgtaactctgtctcgggctcaccgtgccgtgagctcactgtgtcataaccgtctcgggctcaccatgctgcgggctcaccgtgccgcgggctcactgtgccataactgtctcgggctgaccatgctgtgggctcactatgtcgtaaccctgtcttgggctcaccgtgccacaggctcaccatgttgtaaccgtctcaggctgaccgtgctgcgggctcatcgtgtcgtaaccatctcaggctcactgtgccgtgagctcaccatgtcgtaaccgtcttgggctcaccatgttgcgggctcaccaagtcgtaaccctgtctcagggtcaccatgccatgtgctcgctgtgtcat

SEQ ID NO: 15499 - DNA, 1219 bp, Homo sapiens
gctggtggggaagggggccccctgcagacctggctggtggtcctggggagcccgtctgactctgggaggaaggaaccggcccaggccaggcttgggtctgagttcccgggcagggaccgggtcctatgtgcgtccgcgtgggtgagctccccctcgccttccagggtaagcaggaagagaacgacgtggtggagaagctgaacctcttcttggatctgctgcagtcctataaggtgagtcttggctgctccttggctgggggcagaactttcaggaatgatcttaggatccttcaagggtctaactcctgggggacggaagaggagctgagaagccagggctgcaggggaagacggggccttccgtctggcgggggtgcttccctcggccggctccgcagggccctggcgcaggcatccagacagcgggcgaatgcctcccccggccccgcaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcattgtggaggtgggtggcggggcggccgagcaggcccgtgggagcctttcccctcccggccatggtgggacccggagccgtcctggtgggctcccctgggttggctccttgtgtctggaacagagctgggggtgcagtggaggcagggagctggcccgcgtgcccagagcgatgcggctccctgcacggtgctccctccccggccctctcttacctcgccaccttccaaatgcctggtgaaggctgaaggagaaggggccgccctggctcagggagcacgctggtgttcgggccttggtgctcccgtcgccggctgggccgggtgcgaaaggcggctgtttgctccgcagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggaggtgagtccgccctgctccggccgccgtctcggccacggcctttctttgtccctccgcccttccttcaagcccggcagcgcggtggccggccgccctagagaggttctttagtggagttgggctcc

SEQ ID NO: 15500 - DNA, 1181 bp, Homo sapiens
ttcctccttgaataatttctggtaatttgtattcacagcacaaatgtgctgtgaatatattgagcatttaaatatttacttgtttgctaaaatcttctgtaaaaagtcagttttcattgacattgggatgggattctgcctgcctagatgttgcaacaaacctttcaaaatctaggcatctctggaagatctaatagtggatattcttgagatggtcttcttcatttgcattgtgcattgttaaaagcttttcactgttattctcctgtagtctttggttattaccagaacttaattgacctgtcttgactgtttacatttccatcaaagggagagaggagagttccagtccccccagctgtcatgtttaaaatctgaaacaagctagggttaggatttcttttgctcacagtgaaagcatttagacaattcattgtctcttcttgaagacttgtttagtgtgctcagttaatgtattaatgtttttcttggtaaaaatgatcatttgaaaaatctctcttgttcagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtgagtgttctcctgttggagaagtatcatctgtgtctggcacgtcatgatgagggagtgttgcaggagatccttactaacacagctcctgccttgcccaggcacgtgggccgttcacttcttcaggccgccctcagctggaagctatccagagcagtgaatgagaagatgataaagtttgtttttttaagttaaggttttaaagtttttaaaattatctagaataggccagcatggtggcttatgcataaactcccaacactcttgaagcctgaggccaggagttggaggctgcagtgagctatgataacgtagctgtactccagtctgggtgacagagcaagactctgtctctaaaataaataaataaagtaaaaactaactagaatagttttagtttctagaattatcaaatacaggtaatgctgctgcattttctgtgttgggcagtcagttgaagg

SEQ ID NO: 15501 - DNA, 1163 bp, Homo sapiens
agtgctgggattacaggtgtgaaccattgcgcccagccaagatttttttttaaacagctttattgagataattgatatacagtaaatctgcatagttttaaagcgtacaatttaatacattttgatgtgtacatatcacgaaaccatcgccacagtcaaaataatggacgttttgattaacttttctataattatgataatgaaactagagacttcggatcttctggttaggatttccctgtcacttaggagctccctggctgtggatctgtcccccgtgtgactgccttaggctcgaggcaggaagagcagcacagatactcctggcaccgagggcttgtccgtggagaggggtggggcggacagcgcatacctgcctagccttacagtgtgggtatgtgccaacggccctctctcactcaggtatattttcctggagtacgcgtcccctgcccacgctgtggatgctgtgaagaacgccgacggctacaagcttgacaagcagcacacattccgggtcaacctctttacggattttgacaagtgagttcagacttggccacaaggaagtggacgttgacgtgcaagtgactggctgtgtgcgggtggcttggtgcttctcggtgctggtgtctgtcagattgttcacatcctttctggtcaggctgccgcagagccatttcacagccctgccccacacttctggcctacagcacccctccctgttatgccagtcacagccctgggggcgggcaggcaggagcacagcagggccatgctggagcccccacgagttgctctttctagtcgtcagggcgtggggctcagcagtctcctttcttctccaggtatatgacgatcagtgacgagtgggatattccagagaaacagcctttcaaagacctggtgagtggcctgaaacctacatctcagtggtttaaagaaatgctgctgggtgtggtgggtcacacctgcaatcccagcacttagggaggctgaggtgggaggatcgcttaagcccaggaattcaagaccagcctgggcaacaaagtgagacccccgcctctacaaaaagtaaataaatacatacattagctgggcctggcatgcacctgtattcccagctacctgggaggctgaggggggaggatcacttgagcctg

SEQ ID NO: 15502 - DNA, 1281 bp, Homo sapiens
cactggaaagaaacactggcgtgcacggctgtgactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaccggtctttctcctctctttgaatgtagatagagaccttgaacttggtgcctgcctccctccccagtggcaagggcctgcttgccaagccagacctctgcagggcgctgtcccgtccggtcgtcacgcacactcggccaccctgtgtccagcgatgcactagtcatgccacagtctcttctgttgcgttgttttctgtgaaagatgctggtcattttccctggtgagaaccctgtgacttttccttggagttagacacattgggaaacttgtattgagaatggtcagttctgcccgttttttcattttgagatggagtctcgcactatcactcgggttggagtacagtggcgcaatcttggctcactgcaacctccgcc

SEQ ID NO: 15503 - DNA, 1811 bp, Homo sapiens
tcggccccctcatcccgcagttcctcagaggtaacgcagccccttgcaggggtgaacggagctggagtcgcaggggtggaggcagcaggggctgggtggaatggctcagctggctctgagggcagggtgagcctggccccaaggtcaccctgacctgtcccttcccaccctagagctgttccctgtgctgcagaaacgcctgtgccacccctgctgggaggtgagggactccgccctcgagttcctgacccagctgagcaggcactggggaggtgagtgctggcaggtggaggggctgccttccccgcctgtggggggctcactgagccagggtgcaccagcagcctcttgctggctctagaaacttgggccatgtcggctgcccacaaggggatggaggcagaggccgaggcgacaaggctcggccctcagtcacagctgcatgtggccgtttcgacccccaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcaggtaggaggtggcaggttcctcagccagcaactcccgcctggccatcgtgtgtgctcgtttgcttgcgggtggtcgagcggccagcatgcagcgtgggagcagctgctgctgtgggcagcgcctgcagcagtgactgccgaggccctggggctgtgctgggtgtgggacctgtgcgcttcgccttctgtctccccagcacccctccacttagacatggttacctccatttgacagatgggtaaactgaggattggagggccgtgtgctcactgcgcagcatgggaaggtgtcagagcgggctgtggccctagactgcatgtccggggccagcccccatcatgtaccggagtcctgttgcgggagcctcgctcctgccaccccaccaaccatccgcacttgctccctgtcccccagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgagacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtggg

SEQ ID NO: 15504 - DNA, 1129 bp, Homo sapiens
gcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctag

SEQ ID NO: 15505 - DNA, 1080 bp, Homo sapiens
tggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaagcctctcttcctgagctgctttggctcctggctgggcgctggtagggagtccacggctccaggcaggggcattgggggaacagggggacactgagggtggggccgaccaggtcagctccgaggggtcggctgggcggggcctcttgtggttgcgggcggggcctctcggggttgtgggcgggtcttcaggggtgggcggggcctcggagtgactgggcggggcgccggggacaggctctccagggatggggtgggcggggcgccggggaaggctttccagggttggggtgggcagggcttctggaat

SEQ ID NO: 15506 - DNA, 3859 bp, Homo sapiens
ttaggagttagaaaaataaaaaggtatctctggtatggaaacaaaaaagatggtaaatttcctctggagaagaaaatggatgtggttttgcgctgggcctgcccacgagtgttctgagcattcgtcctcagactggtgagcctccgttcgttttgaaatgaagtatttgattctttctgtttcacggccagttgataatgttataaatgaaatttgcttttggtttctggttcaacctgttgcaaaagtcagtctctttccttcttatctttttgccatctttttgtttctattttctctgttctttcttcctccccctaaatttctgcctcatcctgtattttacagaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttaggggttctgggcacagacatctaacctggtattgtaaggcagaggctcccattggaatggtagtg

SEQ ID NO: 15507 - DNA, 1221 bp, Homo sapiens
gtaactctgagtggtataacaaagatatcaaattttagataacacccacatcttcctgagcatcgtgtgattttagtagctagaatttctttgtacagaagtcattgtggagggaaatgatgtgaagaaaagaaagaaaatcctgagaacagagcaacagttgctgtggagtggcgtgagggccgaattcaagtataaaaatctggattagaatcctccggtcacttagtagttgtgtgactttggtcattgttgaactgttgtgaggtttccttttcagatcaaaactttcccttttccttctctcattcccatcttttcaacagatgacatcaccttatatgttacagagaaacagaagccattagatggaaaaaacctcaatatccaacttacagaaatgactgacctgcatttatcttcagcatttcctccttttattaaatatctgaggtcagtatctccacttgggttttgagttccatctttttctgtcttcctagggaacatgtactatcaatttatcttttccctttcttgaatacccaacttgttgctcttaaccagatcagtttcatcggcatttaagcatgttcaagactcttctgtattaaaaaagaaccacgacctcccctaacccttccctaatctaactactgcaccctacctcttctctttgcatttacagcaaagctcccggaaagagttgtctgctcgctgcctcagcccacacctttttcatgtggtttccgcttctgtcattctatcagaattgctctgcagaggctgatcagtgacttcagtgaaaccaggcctaaaggatgctcttcagttcacatctcactcctcagcagcattcttcaccgcttgccgctctatcgttttgaaatacctgtaacaagcatgctgccttggtttccctcctaaatgacctctgctccctctcctctcaatatctttctctcttcccccctgccccgccgaggttgagtatcattataatatcattgtctacctattattgaatgttagcatttcccaaagctagacctagttctgttccattctcaacctacaatcttttcctaagctatttcattcatgtacatagtttgaattgtccttttatgtaatattatagatgattcaaaaatttatctgagctcccatcacgtctatctacctgttaacttgatatttctacttatatctttctaagcc

SEQ ID NO: 15508 - DNA, 1184 bp, Homo sapiens
aatgtgtgatgatgctaacatacatgctatctcgcatgcagtggctgtggatttagtaacatatctcgagtaattttcattttgttgaacataacatttggaaaacagtagtacatatatatgtatatatgtgtgtgagagacccattatttcattattcattctacagatagtacttgggtacacatggatttgatggcccctagcaggaaatatttgtcctcatagagaaaacagcccacagcttagggaccattgctgatgaggatccctttgaaacagagatgacttggagaacactcacatctgtagctgaaacaaacagtctaggaaatagggaagggcatctcagcctcacatacagtgcccacttattaaatttctgcaaatgatgggaggtgctctgttgtggttttcatgcctgttgttaaaggaatctgacagccgaggcatcaggctgctttcttcagccctggtgagagtaggagctctggagtgaagccagtgaatagaactttgccaagattctgaatcttctgggaccatctgtgtctactttttcaaaaagcagattgtgtgaaatgacaggtgggtaggacacagaaggtaatagagatgtgaatgagaagactctaggaagggagagagcaagtacgggtgccagcgggaagagcccagcagaagattgagtgtcctggcagcaggactgagaggatgaggtcacaaatggcttttttctctgggaaggaagccagtggtgtgtgagttgtggcttgggttccagatcttagatcagttttccttacacacaatattaacgttcatattccttccaggaaactatcaagagtaaatggatcaacaggcagccaattggaagagcctcagacatagcaagagggtggcatggagggagaggacatataaccctctctttggcagctgtgcctaccacactctggccttgaagattctgctttggctcccagactagagacccttttgcatctttgccatcagtctttttggaatacagcatcaggcctaaggtcccagatgaaccttaggacagctttcattttgaaaattttggttctcagttcacattttctagctttccattgagtggtgtatcagttagctgttgctgtgtaacaaaacccctctcaaatttagtgacttca

SEQ ID NO: 15509 - DNA, 1131 bp, Homo sapiens
tctttggccagcctcagtatgcgagcacgtaggctagcgctcagcacatgagtctatggaacccaggggaagcaattgcagtttcgtagtagtttgtgtcttaattaagggagcccctagaccttactctttcactttacctaggagtttggttcctaaactcaccattcaaatccagcaacagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcaggtgagcgctgccccagctgggtgtgggcttgtctgttgctccctccagcactctgggacaagcccaccccaccggcatgcccctccgtcattcccttgctgcctggccccacgttgccgggcacagatccttgcctacagagaccagctctgtttcctcacccaccagctttgctcagcccattccattcacgacaaatgcccgggcctctgccacactgctcccatacaggcgtccccggccccacccagagggtggatggcagtctctttcacctattacctggttttgcttttataaatgttacttaaaaaaaatatatttggccgagcacagtggctcacgcctgtaatccccacactttgggaggccgaggcgggcagattgcctgaggtcaggaatttgagatcagcctggccaacatgatgaaaccccgtctctactaaaaatacaaaaattagccgggcatggtggcaggcacctgtaatcccggctactcgggaggctgaggcagg

SEQ ID NO: 15510 - DNA, 1272 bp, Homo sapiens
agagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgcaagcagagtttgtgcgtggacgggggctgggactgccatctcgggataccggtggaactcgggctgccccgcataagccggtcctcagtcttcccatctgtgaggtgggccgggtggatcagggagcaggagggtgtcctcacactgggtaggcttggtttgtgggcagcgctgggtagtggggtgagagctgggagcacttagggtttgtcgctcaccttgaccgcccgccccccccaccccttcgtgaggatcagggaggatggccacatgcagcccatttgaaggggaaacaaagtgggcggggcttggcccctgcccctcagggactgcactgcatcctaggagtcagagcctcctggcttcgagcctcatcccttttgctgatttgtgcaatttggacaaaatcctgcactgttctgtgcctcatttctttctttttttattttttttttgagactgagtcttgctcttgtcacccaggctggagtgca

SEQ ID NO: 15511 - DNA, 1188 bp, Homo sapiens
tgggtctgggatgggctcggtgctggctgggggctcacttccacctggccccctgcagggcacggccgagcagatgaggactgtgtggacgaccgggccagacaccgggaggaacggctgctcggggcacggctggaccgggatcaggagaagctgctcaggtgagggtgtcgggggatcctgagggtctagggggtatctaggagcccctgggggtgaggggcagctggatgaccccaggtgggcttggcccctcgaccatggatgctatggtactgagagcgggagtcactctggtcctcagcatcgggccagccctgcccaggccaggtggccccactgcccctacagtgagtgtggaaggccccgggaggcccttcagttccgagcagtggttgtcctgactcatggcctggtggcaaacagttccttggggcaaccccgcttctccctctcgtcccctgggctgtccgagctgtcgctgacacctatgatcctccttccagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggtgagtgtggggcacagggtctctccccttctctgagggaggggtgggagggggcgggtgcaggacaagagctcagggctggctcctgcctgccgtttcctggggggcctgggcctgcctcccgcattcgtcggaagaaggaatgataatggcctctgcctcgtggggcccctctgccatgcctgtttggggcagatgcccaatgcgggtggctctggggtgctctttgcagccagccagcacccctgtcccttggcttccccactggaggccccaggaggttcaggacttgggaggtggtgctgggctggggctgcccgaggacaaaccgcttgggggctcccagcactgactcaggcctgggcttctcctcctaggcttgggtcccccatctctgcaccagggcatggcccctgcgttcccacctggcctggggggctccctcccgtcagcctaccagtttgtcagggaccccc

SEQ ID NO: 15512 - DNA, 1133 bp, Homo sapiens
agagctgtggggaggtacagccctcctgtgcaggctgcctcccagctctccacctggcagtcttgaccccaccctggcgcctctgctcactggcacaggtggatctggggtttgaggtctcctcccacttcaccctgactttcttgtatgtatggggtcatcgcctcctctctgaagcccacgggtcctctcccagccccaggctgcacccagtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaggggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagc

SEQ ID NO: 15513 - DNA, 1236 bp, Homo sapiens
cagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatc

SEQ ID NO: 15514 - DNA, 2247 bp, Homo sapiens
ggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtga

SEQ ID NO: 15515 - DNA, 1102 bp, Homo sapiens
gagggtggggcgtcacccttgggaacacccgtgcccaccctccgctgcccagggtaggggtggggagccaggctttgggccccacttgataaagtcccctccccagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtccc

SEQ ID NO: 15516 - DNA, 1207 bp, Homo sapiens
agcttcagggccagctcgtgggggagatgtcccttgtgtgaagaacgtggacttcttcctgattgcagcaggaagtctatccatggtcattaaacagggtagtgaaatgatcagatttagcttgtcacatgattattctggtagcagaggactgaggatgtaatgatcccagcaagagactcccaggaccctaagggactcgctgtgcatacagggtccctattgtgtttcttaaagccgactgtggagccgcctggctcacctgcccagggactctggccgcttagcagaaaggcgggtgagggacctggaggagcatgatagtctctcctgctgagggtctaaagatgctcattcccacagggccagttgttagaaatgcaggcactcacacagatacgctcttctctcagtggtgcctgcctttctttttttgtttaattgttccttgcagtagcacattccatgggagattccatgacagggctattctctcgatttcagtggttttgattttgtgtctgttgtcatagcgcctggagctaagccttatcaaataattgcacatctggtgatcacttaggcttccagaaatgtgaggcagggaggaccctcaagggactctggtcagcactcctactgctgagaggcttcaccgcattcccccagactcaccaacagcctcgttacacttgttacggtgtgtgtgcaccagtgcgctcagcgcctgcatcctcacaacccagccccttgtgaggctggccggaccacagcttgccctgttctgcaccattctagggctgaaggatttgcccaaaatatgtcactagatggtgacaaacaggcccttagtccagtgcctttagcaggggctggctggagcagcatggccatgttcagatgcctgtcccaccacttgttagctgtgtgcaccgcccccccgccaccgcaccaccaccacccctacccgagggtgacaggatcctcctgaaaagtctgttaggaggattaaatgacttgataactaagatgtttcatccataagcactcaataaatggtagctgctgctgttattcattccactgtatctaatctctgtactcttaaattttacaactttactcaataacttttaaaatattctacacttgtggctcccataaatttcctctttgctctattgaggccatttctagtccctgtgtg

SEQ ID NO: 15517 - DNA, 1251 bp, Homo sapiens
ccgggcactttgcagtttctcaggccccgggcagcagtgttgataggctcaaaactcctgaggcctggtaggttttgtaggtggattttttcccctcttctacttgttaacatttcttggctgggcacagtggttcatgcctgtaatcccagcactttgggagaccaaggtgggcggatcacttgaggttaggagttcgagaccagcctggccaacatggcgaaaccctgtctctaccaaaaaatacaaacattagcagggcgtggtggtgtgcacctgtagtcccagctacttgggaggcagaggctgcagtgagccaagatcacaccactacactccagcctgggtgacagagcaagactctgtctcaaacaaaaaaaaaaaaaaaaaattcttgcctagtcttctgggatttaaggtcaaaatcaatgcaaatctctcttcctaattttacccaagaagaatttaattatatatcatgtaaccttttaagtgactgcctcttccttcctcactgttgtgtccttgttgcagaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtg

SEQ ID NO: 15518 - DNA, 1356 bp, Homo sapiens
gattctcgtgcctcagcctcccaagtagctgggatgacagatatgccaccacacccggctaatttttgtatttttagtagaaacagggttttaccatgttgtccagaccagtcctgaactcctagcctcatgtgatccccctgccttggcctcctaaagtgctgggataacaggcgtaagccaccacacctggcccatattatagttttattttgaacattgaactgtgttcatctgtgtaattagcatgtggatctcctcttttgtgaagtatctgttcacataagcacgtcctctcaccatttcaggatagtccctgaccctcttctccgtccacgtttgcttaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataaggtaaagttttaattttttactttttctctttttatctaaaatttttatttttattttttatttttttgagacagagtcttgctctgttgcgcaggctggaatgcagtggcatgatcttggctcactgcagcctccacctcccgggtt

SEQ ID NO: 15519 - DNA, 1099 bp, Homo sapiens
gagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttatctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgc

SEQ ID NO: 15520 - DNA, 1114 bp, Homo sapiens
ggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttct

SEQ ID NO: 15521 - DNA, 2553 bp, Homo sapiens
gcggcaccactgtcccaacactcccatcatcctagtgggaactaaacttgatcttagggatgataaagacacgatcgagaaactgaaggagaagaagctgactcccatcacctatccgcagggtctagccatggctaaggagattggtatggaatcctgtgtttttcctcctccttgtacctcttttattgtagtgacagagactggagtccagtctgggaaaggagggtgtgtgtctcccactcagggcctggtgtactcttggggaaccagctggcaaggccctgtgggtcttaacgtcagcgttggaaggtggaagcagggctgggagccggcagaaggcgcccgggccccaggagctgcctcccgctggtggtgtgatcagaagagagtggggtcgagtgtacattgccgtgtggtcgtgtttcctgtaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaatactggtgtttttgagacttgatgaacaagttcctggtgtgtgtttgtttgccttgctttaaagtcctgggttgttggagacagtcattttcaatgcgtgtctccacacaggagggacagggagtgccacctccaggggagaactgggtgagcccaaatacggcaggagtggaggtgacattcatgtttggacctgtcgaacagtggcgaagctctgagggagaagcgcctatcggggtgtgtgtgcacatcctggcccagagctaggggctgaagatggagatgttgggaccctagactggccctggaagagtagaggttggtgaaccacatgcccttaagatcctttccagaggctgagtgcgtggcttacgcctctaagcccgacgctttgggaggctgacacaggaggagcgcttaagcccaggagttctagaccagcctggacaagaaagag

SEQ ID NO: 15522 - DNA, 1263 bp, Homo sapiens
cagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctatt

SEQ ID NO: 15523 - DNA, 1165 bp, Homo sapiens
gtatcttgtcaactggatctggcgcttctactttgagggcttctttgacctcattgctgtggtggccggcgtagtccagaccatcctatactgtgacttcttctacttgtacattacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctcacatttttcatgtcactagaaatctacataattttcagtagccacagagtgtttcattatgtgcatgtaccataatttatttacccagcccccattcatgggtggtcaggccgttactggtttgctgttaaaatccagtcattaaatcagcatccttgtgtatatgtgtttttgcatttgtatgaacataggacgtgtgaactttacaaatatttgatgaaagctatcatccttgttcagaaaaaaaaaaacatttatgccaggtgcagtggctcacgcctgtaatcgagcactttgggaggccgaggcgggcggatcatgaggtcaggagatcgagaccatcctggctaacacgtgaaaccccgtctctactaaaaatacaaaaaacttagccaggcgtggtggtgggcgcctgtagtcccagttactcgggaggctgaggcaggagaatggtgtgaacctgggaggcggagcttgcagtgagcccagatcgcgccactgcactccagcctgggtgacagtgcgagactctctctctcaaaaaaaaaaaaaaaaaagatatttacgcaaatgcacccaaatgcatgtatatagttttgaggggttcaggagcccctgaaacccaaccacagatcccaggctaaaaatccagctatacaataaaattcctaatggtggaattgctaggtaaaaagcatatataggtcgggt

SEQ ID NO: 15524 - DNA, 1249 bp, Homo sapiens
tcacactgaattcaaaggagtattgtagtaaaaagacaactgtaaatttgtcagtattgacaaaatgtcctctctgttttttggtttgttttttgagatagggtctcactccattacccaggctggagtgctgtgacgtgatcatagctcactgcagcgttgacctcctgtgctcaagtgatcctcccgcctagcctctgagtagctgggaccatgggtgcatgccgccaccacctcagatttgtcttgtagtcagattgcaagtgctcaatacccacatttggctggttgctcctgtactggacaccacagttccaaaagcttagtttggaactaagcagctgccattttcctctgatgacacatccagtggacagattatgaaaatctcagcaggtgtgcggtgtccttgtctcgtcaagcaccatcccagcacgtgcccccttgtttctgtgcaggtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcaggtaattatgctgtaggtttctgacttcaagtttcagaatcgcaaaaaagacatttatttttccagtaaaagcatgaagttaggtggggtgtggtggctcacgcctataatcccagcacttttggaggccgaggtgggaggatcgcatgaggctaggagttcaggaccagcctgggcaacacccaaatgtccatcaactgatgattgaataactggtctcctgtagagaccttgtctctacaaaaaatacaaaaatgagccagggccgggtgcagtggctcatgcctgtaatcctagcactttgagaagctaagacaagcagattgcctgagctcaggagcttgagaccagcctgggcaacatggtgaaaccccatctctactaaaatacaaaaaaattagctgggtgtggtggcacatgcccattgttctagctacttgggaggctgaggcacaaaaattgcttgaacccgggagggagaggttgcagtgagctgagattgcaccactgcactccagcctgggtgacagagcaagaccctgtctca

SEQ ID NO: 15525 - DNA, 1107 bp, Homo sapiens
taccagagaaaaagaagtagacttccgtactcagagttaacagcaaagaaagaaaaacaacacgacaggaagccctggatccacaaaggatcctggtgggaagaataggaaattctgtgtgcaatactgacatactcatccataccccaccccaactgtgactgtcctactaattaatctggttttatggattttccataatgtgctgttttagcagcaaatagaggggtaaactcatagataatagctaaatactgttagaaattaactttccgttatagctaaatgttaccagaatttttactccggttatgtatacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaaggtatggtttactttattaagcagtaaacataagcagtattttagtctaaattttgtcatattcctgtctgtatctgttaattaaaatgggctatatattccagatattaaaaataattcttggtttgcctcaagagaagggaattgctaaaactcagatttatttagggaataagatattaattttgaattcgtttttaagtagaaatagttcagaacccatgatttggggaagggcataactattcagatttgatttgtttctgaaaatgtttttctaggttcagttttgttatatgtgtgtctttggtttttgttacttgttttggtcatagcttttgcttaagtcttgttttcctagagaaacttgaggtgtatgtaagtttcgatttatatttttataattagttaatagaactaatcttttttttcctcaagaggcacaaagaacaaggaagttaaaaaccaaggatgcgttctaaagacttcattttctcctagcctcctacc

SEQ ID NO: 15526 - DNA, 1464 bp, Homo sapiens
atgaactgccacttcagcagcatgtctttcctgctcttcagaaactcgttcagagcagtgagaaatttctgtcagtaatctattaaaaactggctgctttcttttatgaagtgccaagcagagactatttaaggcagcatttagcatgcctatgaagcaccaggagaacttattaaaatgctgattctgagtcagtaggtctgggcctaagattatgcatttctaacaggctcccaggtgatgctgctgcttttaatcagtaaactacagtttgagacgaatttagattataatgtcaactcttactagctccagtgatgtcctagataacactgacatgaaaccaataaatcagagtgtcagttcacattaggatgagtttgctttcctttggctaaatcactaatagagggataaatagggactttgaaattaggacagtgctttcttcagtataatttattaatatttggattttacatctatgtaaataaccttttaaaatgttttgtttaatagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactgactgaattttgttgataaaaacatgttaatatgtgtatgtttctttagtaccaacaacaaggactcttccttagtctttttaaatagagtggcagtataacaaaatagatgagaacagggacatcagcaatcagcagtagtcacttagcaaatagctattgatgctgttatatgccaggcactgagaatgtagaagtaaatcacagccaatttccagttctcgtgaaccttacatt

SEQ ID NO: 15527 - DNA, 2815 bp, Homo sapiens
ttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaagttgtgagataaatgttgtcttttatgggtagtttggggttatttttccaaaagtttaaaattgttttcccatcaaagctatttagtttgaattggctttcataagttttactgcaatatatgtattatttact

SEQ ID NO: 15528 - DNA, 1164 bp, Homo sapiens
aaggaagaaagcaagatcacttctactggatttcagacagtagggataccttgtgaataaaacagacaagacacctgcccttttggagcttatgcgctactgggagaagagataagactgaaaaataaattaataaatgggagcacatattaagtgctaaaggaaatagaggaaacaatgggtggtgagttagataataacaagtatgtctattttagattaggtggccaggcagtaactcagtttagtccatctgagcatttgctcttatttcagtagttctttgctaactcaaggagctactgtacttaaaaacatgcaaaatatgttgtatttgtggcatagttcatatttacactatcataaaattatggccgagaagttaaatattctaaatgtgtcaacatagttctctgtaaaactgacttactttccaaatatattttgaaataaaacaatataaaaatgttttctgtttttaggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggtattaggttataaactaagatattagttataatctaagatgttagcagttcatggaatcttttaaagaaaagaggctaataattttcaaatatctaatcacttaaaattttaatttaatttttgttggaggagaaaacacagcagtatatctataacagtaaatacttagctcatctcttatgccttggtttagggctgtaaaaacaaagatgtgtcttaaatgttagtataatattataaggagtgctcaagtgtgtccattttcaatgttttctcttaaagatagttcacataacattttttaaaatatattttcttaaagattagggctactttagcctacaagtatttttacgatccatatttgagtgttttagtttatactttctttgggatggttattgtttgacctttaagaaactctg

SEQ ID NO: 15529 - DNA, 1207 bp, Homo sapiens
tccctaaacttcagcttggcagtagtttataatttgatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattacagatttttacttttagaattgcagagcccctatcccacactggagaatattttttattactgtctgttatatatgtgtctatgtgtgtgtgtatatttatgtgtgtatgtataaatatgtattttttaaaggagccttttccctcctttgattttaagataagcaatcttttggcataacattatcgtcttcctagaaaagccaagatgaagaatctatcttacaactttttctcttcagtagagaaaaacatgtaccatttcaggtgaacatacaaaattttcactttctaccttttgccttccaatgtcctgatttgtcttc

SEQ ID NO: 15530 - DNA, 1320 bp, Homo sapiens
tatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatagagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatt

SEQ ID NO: 15531 - DNA, 1112 bp, Homo sapiens
ctgagttcagtgagtttcacaaacacataaaaagcaagcttaaatactggcagagggtggcctgaaaaggaaattcagctttcttgctgaatattattattaatcaaaataagtataaggatcaaataattataattgcattaaactctttggggacttgagacttctgtcatttctataaactaagaatagctattattgaattcacttatgaatcacaattccttacacttatttgtcatcttacacatcacaaaatgctttcacctgttatgatttggtttgatgttcacagtgcaaatgtgcaggacaggtattattagccccgtttaatagatgagtgagttgaacttacgaatggtcaagagctctttccataggcaacattgcctctaagatcctcttagctgtccctttgtgatgaataatcacttctttgctcaaggaagaactaggccttcaaaggttgctgtcattttatataaatgttgactgaaggtgtgcacaacctgacctggaaatacaagaagtatgtcattgacatatctttatgatattcaagcaggttaccttttttctaccaataataattgaaataaattaaagagagtacagattaaacatatgttttcaattgatggtgggaatgtaaagaggctcttaatgaatttgttaacggctgtttccattttgctcaatgctcggttatcaatgccaatgagttttggactttgatcataataacatttacctgtttctttaaaagctgttttttttttcatactgaaggttaccctagttgcatagtgcacttttgccagcctgatgacgcttctgaatgcctccagaccagtgctccctaagaatctgtaaactattcttttcatgccagctgttgtgctccttttattcccccaatttgcatatggtgctttactgaacaagagagtttttctttcggtttcacccaatgcaggtgtgcagtcattctgtgagagcttttgtaattggctatgtaaattatctctcaggtccaagggccaaaaatatagtttttcataaagacaataaaaaaccacaatatttatattttattttttttcagtcttctg

SEQ ID NO: 15532 - DNA, 1192 bp, Homo sapiens
gagaagtaggataagagcctcgaggttgtcagcaatgcatcctgtaccaccaactgcttaatgcctctggccaaggtcatccatgataactttggtatcgtggaaggactcatgaccacagtccttgccgtcactgccatccagaagactgtagatggcccctctgggaaactgtggtatgatggctgtgggctaatcagaacatcatccctgcatctactggagctaccaaaggtgtaggcaaggtcatccctgagctgaatgggaagctcactggcatggccttccatgttcccactgccaacgtgtcggtcgtggacctgacttgccatctggagaaacctgccaaatatgatgacatcaagtaggtgatgaagcaggcatcagagggctccctcaagggcatcctgggctacactgagcaccaagtcatctcccccgactttaacagcgacactcactcttccaccttcgattctagggctggcattgccctcaacgaccactttgtcaagctcatttcctgatatgacaatgaatttggctacagcaacagggtggtgaacctcatgacccacatggcctccaagaagtaagaccccccagaccaccaaccccaacgagagtgcaagaggaagagagaggccttcagctgccggggagctccctgctgcactcagtcccccaccacaatgagaatctcccttcctcacaatttccatgcagaccccctgaagagggaggggcctaaggagccccaccttgtcggttaccatcaataaagtcccctgagctcacctaaaaaaaaaaaaaaaacaaaagaaaataaaattatagccaatttcatttaaaataaagaaacaaaaattaaaaataacacactgtcataaattaatgtaagactatactaaaatcacatttcattatacattggggttacttttaaagtgtgaagcttgtttaatgattaaatatcttaaattagtttattatgtgaaaatattttgttgataacaataaggataattatctaataatataaaaattctaaaattttcaacaatttctaagtataattttttagaaactagaaagaatgaatagcttcttaaaatgctgttttaaattgtctattagaattcagtggacaacatttgtcataataataacctagaaggattcatgttaattt

SEQ ID NO: 15533 - DNA, 2688 bp, Homo sapiens
ctctgcatgaacgtgacactgactgcataatttgtttacaagaaattatgtccaacaaggtgatctaagaaattcaaccacttgataaagtttgcttcctcatttgaagaattcatctttatatcttgctgcagtatctggcaactttccactctcctcccttcatgatagtaattatgaaaagttattttcatcccaagtagtctacatggtaaaaggaaatttttgttagtagcatagacttggtgcttttttaaaagaacaaaagttttaaatgaaagacaatttaagactactcaagtcattataaaagtcaattatcaaagttaaaacattatcacatatatattaagaaatcctagctcattgaactcgcctgcagctctcgggttcctgtggctttcttctttatcggagccagggctacatgccagcaaccatgtccaagggacctgcagttggtattgatcttagcaccacctactcttacgtgggtgttttccagcacggaaaagtagagataattgccaatgatcagggaaactgaaccactccaagctatgtcgcctttatggacactaaacagttgattggtgatgccgcaaagcatcaagttgcaatgaaccccaccaacacagtttttgatgccaaacgtctgattggacgcagatttgatgatgctgttgtccagtctgatatgaagcattggcccttcatggtagtgaatgatgctgacaggccccaggtccaagtagaatacaagggagagaccaaaagcttctatccagaggaggtatcctctattgttctgacaaagatgaaggaaattgcagaagcctaccttgggaagactgttaccagtgctgtggtcacagtgccagcttactttaatgactctcagtttcaggttaccaaagatgctggaactattgctggtctcaatgtacttagaattattaatgagccaactgttgctgctattgtttacaaaagttcagacaaaaaggttggagcacaaagaaacgtgcttatctttgacctggggggtggcactttcggtgtgtcaatcctcactattgaggatggaatctttgaggtcaagtctacagccagagacaaccacttgggtggagaagattttgacaaccgaatggtcaaccattttattgctgagctcaagcgcaagcataagaaggacatcagtgagagcaagagagctgtaagatgcctccgtactgcttgtgaacatgctaagcgtactctctcttccagcacccaagtcagtattgagatcgattctctctatgtaggaattgacttctatacctccattacctgtgcccagtttgaagaattgaatgctgacctgttctgtggcaccctggacccagtagagaaagcccttcgagatgccaaaccagacaagtcacaaattcatgatattgtcctggttggtggttctattagtatccccaagattcagaagcttctccaagacttcttcaatggaaaagaactgaataagagcatcagccatgatgaagctgttgcttatggctgtccaggcagccatcctgtctggagacaagtctgaaaatgttcaagatttgctgctcttggacgtcactcctctttcccttggtattgaaactgctagtggagtcatgaccatcctcatcaactgtaataccaccattcctaccaagcagacacagaccttcattacctattctgacaaccagcctggtgtgcttattcaggtttatgaaggtgagcgtgccatgtccaaggataacaacctgcttggcaagtttgaattcacgggcatacctcctgaaccccaaggtgttcctcagattgaagtcacttttgacattgatgccaatggtatcctcagtgtctctgctgtggacaaaagtacaggaaaagagaataaaattactatcactaataataagggccatttgagcaaggaagacattgaacgtatggtccaggaagctgagaattaaaaagctgaagatgagaagcagagggacaaggcgtcatccaagaattcacttgagtcctatgcattcaacatgaaagcaactgtcgaagatgagaaacttcaagacaagattaatgatgaggacaaacagaagattctggacaggtgtaatgaaattatcaactggcacaataagaatcggactgccaagaaggaagaatttgaacatcagcagaaagagctggaggaactttgcaacccaatcatcaccaagctgtaccagagtgcagaaggcatgccaggaagaatgcctgggggattccctgttggtggagctcctccttctggtggtgcttccttagggcccaccatcgaagaggttgattaagccaacccaagtatagatgtagcattgttccacacatttaaaacatttgaaggacctaaatttgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaagaaaccttaaaaatgatttcattcgattatcaataactttgattataccaaagttatcaaa

SEQ ID NO: 15534 - DNA, 1292 bp, Homo sapiens
ttagtgagagagagaaaatatcttagaagttatgtaaaccacaaaacaaagcagtaccttatattactagcctctttttgttgcaggatctctccctctaaattacagcagttcattcagcaagtagggaaggtaattcttgttaatcctctattctgttggcgattcttccacgtacttagtagagttaaggcaaaaacttaccgaattggaagtatgtatcagaaggaattcttaattattcactttgaaataaaagaattttccttataggttccaagtagtagactgtactataatactgctcttctgaaataaattgaatatttttaccttgccaaaactatcattgaaggctggaattttaggtacagtatttttctgtgaatgattttatgttgttaaatattcttttaaaaattcatatctgtaattgttactgtagaaaaccaaatacaaagaattctaaaacctttgtaccgtctctgtgtatttgagattacttaaaatatctttttttctgttccaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtgcaggttttcttttcttttttcttttttttttttttgagatagtctctgtcacccaggctggagtgcag

SEQ ID NO: 15535 - DNA, 1159 bp, Homo sapiens
tttcatccacttcttaacctctcacacatggttatactctggatttaaatgtaaataagagtgataatctgcctgtttaacacagggaattatttttctcttgacaagagaaattgacagtgctctctatttagaggccatgaaagtaatttgatctaaacactgtgtactaagattattatgttttatgtcagaaaacaataaagttactaagctctgttagcatattctaaatgtttgaaatttagaagcaatggtgagaagacagactttttattgacaagaacttaattagcactttcttattgcttatcaaaacaaatgtgttaaatgcttctcccttacgaaataaagaaaggtgaaaagatggcctaggttgattttattttttgttttgtctttgtttctttgtttcgttttggtactttatttttttttaatcagacataatgctaatcagaaatcttagctgatgctgcacattggcttttcccaacggtccagaggctgctaattttagcggaaatgaagacattgatcaaagctctggtgagatgggggagtgagtgtgtgaacaaaaagagagctaatttaaaagaggcatcagactttcaaaggacagtgtcacaaaagttcttacagttcttacagggactttgtaagggaatccattcttatttctttaaaaaattgtcttctggtaaagccctgttaaattaactgaggacacagaaattaaacatttcaaaaagaataaacatattgataaaacaaatatattagtgttgttgtatgtttttaaatacttacttccaaatgatttaatctattttggtcattaaaatatgtcttaatttctcaaagaaaggcatgaagtcttaaattttatgagttttttatgctatcaatgagaaagataaagtaaaaattacagtagaaaaagacaaagtccttcaacaaagttaagaaagtttataataattggctaatttttttgaggtagttcatgtagagtgtgttgggagctatcctgaaggttaagtttattaaaatttagggtaaagtagtaagtagttccaagttcaggagatacacctgaataattctgaccacagtataaattttgcaatatgtcgaaaatgaaatcccaagcataagc

SEQ ID NO: 15536 - DNA, 1178 bp, Homo sapiens
tgccttctcatcctttacgctgctggtgtgcaagctgttaagcacagagtgtttaattaatggatagataccattagagagacagctggacctgcatccagatgagtttggattcaaggtgccaggagataaagatctgaaagtgggaaagctgaactgcaattgggttcatttataaaagaggctgttaaaggtcaactgtgttttcttgtgctagagataaagagatgctattaaaaacaattggaaagtaattcataagggagcactaagtcactcatgttaaattaatttgtctttctgatagcatggcattcatgatgggaaagtaaatttaccccaaatcaagatctttcaaaaacagccattgatcatgtactccctgcaaagccactggaataaacccctgtgtgccgggaccactggtgctgtgtgatcacagcatctccatagttcactgaagccccttcccaggctgagaattaaccaattattctgaaggacagcaagtgcagtgacatttctgtggatatgctgagatgcctgagcctgctgatgtctttctgtcgcctctgatgaactagtggccaagcaccagaacaacccatcgtgcacaattccacttttctgaaattcagcaatgtattagaacattctagcccactgagctccacttacaaccctcccacctctctgccagtactacaacacaccccatgttcaaacatacacttaccatgatgaaaactttttaatttatccaaacaatatatttacaattatgaatggcagtttaactccacatagtgacatcaaacactttctttgatcatctcctcttcaaggtaaagcttttcattcaaacactatcaactgttctccccagtttcctgatggcagcacatgttatgacaaagggtgattgcttttagtgctcagaaatgccagcctattaagacacatcttcatctttctctgggcaagatagagattgtgtctatttgctgccatgcatggggatgagaggggaaaaatccactccatcagattgtgattcctgtagacataaccctgggtatgaccaggttctctctctctctctttgttgccagaggaaaactgcttgttgcttctttttctttcttgagattgaaaactaattggggtctttctttatt

SEQ ID NO: 15537 - DNA, 1329 bp, Homo sapiens
aatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttt
